US008765688B2

(12) United States Patent
Liebmann et al.

(10) Patent No.: US 8,765,688 B2
(45) Date of Patent: Jul. 1, 2014

(54) ANTI-DANDRUFF COMPOSITIONS CONTAINING PEPTIDES

(75) Inventors: Burghard Liebmann, Bensheim (DE); Heike Brüser, Speyer (DE); Heiko Barg, Speyer (DE); Daniel Hümmerich, Frankenthal (DE); Hubertus Peter Bell, Mannheim (DE)

(73) Assignee: BASF SE, Ludwigshafen (DE)

( * ) Notice: Subject to any disclaimer, the term of this patent is extended or adjusted under 35 U.S.C. 154(b) by 87 days.

(21) Appl. No.: 12/809,102

(22) PCT Filed: Dec. 19, 2008

(86) PCT No.: PCT/EP2008/010912
§ 371 (c)(1),
(2), (4) Date: Jun. 18, 2010

(87) PCT Pub. No.: WO2009/080306
PCT Pub. Date: Jul. 2, 2009

(65) Prior Publication Data
US 2010/0310644 A1      Dec. 9, 2010

Related U.S. Application Data

(60) Provisional application No. 61/080,705, filed on Jul. 15, 2008.

(30) Foreign Application Priority Data

Dec. 21, 2007 (EP) .................................... 07024988
Jul. 7, 2008 (EP) .................................... 08159834

(51) Int. Cl.
*A61K 38/10* (2006.01)
*A61K 38/00* (2006.01)
*C07K 7/00* (2006.01)
*C07K 14/00* (2006.01)
*A61K 9/127* (2006.01)

(52) U.S. Cl.
USPC .......... 514/21.4; 530/324; 530/325; 530/326; 530/327; 424/450

(58) Field of Classification Search
USPC ................. 530/324, 325, 326, 327; 424/450; 514/21.4; 536/23.1, 24.5
See application file for complete search history.

(56) References Cited

U.S. PATENT DOCUMENTS

| 6,255,279 | B1 | 7/2001 | Christophers et al. |
| 6,800,727 | B2 | 10/2004 | Hahm et al. |
| 2003/0096745 | A1 | 5/2003 | Hahm et al. |
| 2010/0310644 | A1 * | 12/2010 | Liebmann et al. ............ 424/450 |

FOREIGN PATENT DOCUMENTS

| CN | 1511843 A | 7/2004 |
| CN | 1896107 A | 1/2007 |
| CN | 101302249 A | 11/2008 |
| EP | 0 866 804 B1 | 9/1998 |
| WO | WO-00/32220 A1 | 6/2000 |
| WO | WO-03/014146 A1 | 2/2003 |
| WO | WO-2005/007758 A2 | 1/2005 |
| WO | WO-2009/080306 A8 | 7/2009 |

OTHER PUBLICATIONS

Cutsem, J.V., et al., "The In Vitro Antifungal Activity of Ketoconazole, Zinc Pyrithione, and Selenium Sulfide Against Pityrosporum and Their Efficicy as a Shampoo in the Treatment of Experimental Pityrosporosis in Guinea Pigs", Journal of the American Academy of Dermatology, vol. 22, No. 6, (1990), pp. 993-998.
Darbre, P.D., et al., "Concentrations of Parabens in Human Breast Tumours", Journal of Applied Toxicology, vol. 24, (2004), pp. 5-13.
Hancock, R. E. W., et al., "Antimicrobial and Host-Defense Peptides as New Anti-Infective Therapeutic Strategies", Nature Biotechnology, vol. 24, No. 12, (2006), pp. 1551-1557.
Hancock, R.E.W., et al., "Cationic Peptides: A New Source of Antibiotics", Trends in Biotechnology, vol. 16, (1998), pp. 82-88.
Hanson, L.H., et al., "Evaluation of Cilofungin, a Lipopeptide Antifungal Agent, In Vitro Against Fungi Isolated from Clinical Specimens", Antimicrobial Agents and Chemotherapy, vol. 33, No. 8, (1989), pp. 1391-1392.
Kim, H., et al., "Osteoclast differentiation-inhibiting peptide P1", Database EBI Accession No. ABR40065, Jun. 20, 2003. (X002519483).
McDaniel, S.C., "Sequence 140 from Patent WO2005007758", Database EBI Accession No. CS015658, Feb. 10, 2005. (XP002519484).
Hahm, K., et al., "Cecropin A-magainin 2 (CA-MA) peptide derived from insect peptides", Database EBI Accession No. ABU10349, Sep. 9, 2003. (XP002519485).
"Antibiotic-related peptide amino acid sequence—SEQ ID 6", Database EBI Accession No. ADV69545, Feb. 24, 2005.
Lee, D.G., et al., "Structure and Fungicidal Activity of a Synthetic Antimicrobial Peptide, P18, and Its Truncated Peptides", Biotechnology Letters, vol. 26, (2004), pp. 337-341.
López-García, B., et al., "Expression and Potential Function of Cathelicidin Antimicrobial Peptides in Dermatophytosis and Tinea Versicolor" Journal of Antimicrobial Chemotherapy, vol. 57, (2006), pp. 877-882.
Nenoff, P., et al., "In vitro Activity of Phytosphingosines Against *Malassezia furfur* and *Candida albicans*", Acta Derm Venerol, vol. 82, (2002), pp. 170-173.

(Continued)

*Primary Examiner* — Chih-Min Kam
(74) *Attorney, Agent, or Firm* — Drinker Biddle & Reath LLP

(57) ABSTRACT

The present invention relates to the use of special peptides in composition which can be used in particular in hair and skin cosmetics, and to such peptide-containing compositions. In particular, the present invention relates to the use of such peptides as active ingredient for inhibition or treatment of dandruff which does not accumulate in the body or in the environment. Furthermore, the invention relates to the production of such compositions, to the peptides used themselves, to their production and to coding nucleotide sequences for such peptides, to dispensing systems for such peptides and to screening methods for identifying suitable further peptides.

12 Claims, No Drawings

(56) References Cited

OTHER PUBLICATIONS

Nenoff, P., et al., "Spezies-Abhängige In-vitro-Empfindlichkeit van *Malassezia* gegenüber Antimykotika", Aktuelle Dermatologie, vol. 33, (2007), pp. 26-32.

Shin, S.Y., et al., "Cecropin A—Magainin 2 Hybrid Peptides Having Potent Antimicrobial Activity with Low Hemolytic Effect", Biochemistry and Molecular Biology International, vol. 44, No. 6, (1998), pp. 1119-1126.

Shin, S.Y., "Salt Resistance and Synergistic Effect with Vancomycin of ∝-Helical Antimicrobial Peptide P18", Biochemical and Biophysical Research Communications, vol. 290, (2002), pp. 558-562.

Shin, S.Y., et al., "Structure-Antibacterial, Antitumor and Hemolytic Activity Relationships of Cecropin A-Magainin 2 and Cecropin A-Melittin Hybrid Peptides", Journal of Peptide Research, vol. 53, (1999), pp. 82-90.

Shin, S.Y., et al., "Antibacterial, Antitumor and Hemolytic Activities of ∝-Helical Antibiotic Peptide, P18 and Its Analogs", Journal of Peptide Research, vol. 58, (2001), pp. 504-514.

Wade, D., et al., "Antibacterial Peptides Designed as Analogs or Hybrids of Cecropins and Melittin", International Journal of Peptide and Protein Research, vol. 40, (1992), pp. 429-436.

"Cecropin A; Magainin; genetic engineering; protein production; fusion protein; Vaccine, general; Antimicrobial", Database EBI Accession No. ARA28054, Apr. 17, 2008.

"Self-assembly short peptide R418, SEQ ID 1", Database EBI Accession No. AUO71580, XP002519487, Feb. 19, 2009.

* cited by examiner

ANTI-DANDRUFF COMPOSITIONS CONTAINING PEPTIDES

RELATED APPLICATIONS

This application is a national stage application (under 35 U.S.C. §371) of PCT/EP2008/010912, filed Dec. 19, 2008, which claims benefit of European application 07024988.3, filed Dec. 21, 2007, European Application 08159834.4, filed Jul. 7, 2008, and U.S. Provisional Application 61/080,705, filed Jul. 15, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Revised_ Sequence_List_13111_00148_US. The size of the text file is 1,257 kilobytes, and the text file was created on Jun. 21, 2012.

The present invention relates to the use of special peptides in compositions which can be used in particular in hair and skin cosmetics, and to such peptide-containing compositions. In particular, the present invention relates to the use of such peptides as preservative or as prevention, active ingredient for inhibition or treatment of dandruff which does not accumulate in the body or in the environment. Furthermore, the invention relates to the production of such compositions, to the peptides used themselves, to their production and to coding nucleotide sequences for such peptides, to dispensing systems for such peptides and to screening methods for identifying suitable further peptides.

BACKGROUND OF THE INVENTION

In the cosmetics field, microbial activity can lead to undesired changes, such as body odor, dandruff formation or open inflammations and spots. The prior art discloses the use of antimicrobial and/or antifungal substances in preparations, e.g. in cosmetics or in medicine. However, the development of new antimicrobial and/or antifungal compositions is constantly necessary due to the development of bacterial or fungal strains that are resistant to active ingredients. Of particular interest is the development of novel antimicrobial and antifungal compounds, respectively, which do not show negative effects on the human health and which show a good activity spectrum against harmful germs.

Diverse antimicrobial peptides are already described in the literature and summarized in reviews (Hancock, R. E. W. and Lehrer, R. 1998 in Trends in Biotechnology, 16: 82-88; Hancock, R. E. W. and Sahl, H. G. 2006 in Nature Biotechnology, 24: 1551-1557).

Fusion peptides, which combine two effective peptides, are likewise described in the literature. Wade et al. report on the antibacterial effect of various fusions of cecropin A from *Hyalophora cecropia* and bee toxin melittin (Wade, D. et al., 1992, International Journal of Peptide and Protein Research, 40: 429-436). Shin et al. describe the antibacterial effect of a fusion peptide of cecropin A from *Hyalophora cecropia* and magainin 2 from *Xenopus laevis*, consisting of 20 amino acids. Cecropin A consists of 37 amino acids and exhibits activity toward Gram-negative bacteria, but lower activity toward Gram-positive bacteria. Magainin 2 consists of 23 amino acids and is active against bacteria but also tumor cell lines. Compared to the fusion of cecropin A and melittin, this fusion exhibits considerably lower hemolytic activity for comparable antibacterial effect (Shin, S. Y. Kang, J. H., Lee, M. K., Kim, S. Y., Kim, Y., Hahm, K. S., 1998, Biochemistry and Molecular Biology International, 44: 1119-1126).

US 2003/0096745 A1 and U.S. Pat. No. 6,800,727 B2 claim these fusion peptides consisting of 20 amino acids and variants of this fusion which, as a result of the exchange of amino acids, in particular of positively charged amino acids and hydrophobic amino acids, are more positively charged and more hydrophobic.

Further developments of this cecropin-A-magainin-2 fusion peptide are described by Shin et al. 1999. It is found here that the construct P18 (HT2, SEQ ID NO:3) had lower hemolytic activity compared to the starting fusion, although the antibacterial activity toward *Escherichia coli* and *Bacillus subtilis* was not impaired (Shin et al. 1999 Journal of Peptide Research, 53: 82-90).

Furthermore, Shin et al. 2001 investigated the activity of the construct P18 and analogous constructs for their antibacterial activity also on other target bacteria such as *Pseudomonas aeruginosa* or *Proteus vulgaris* (Shin et al., 2001, Journal of Peptide Research, 58: 504-514).

First experiments on the effectiveness of P18 against fungi was published in January 2002 by Shin et al. Here, better effectiveness of the peptide P18 towards *Candida albicans* compared to magainin 2 was established (Shin et al., 2002, Biochemical and Biophysical Research Communications, 290: 558-562).

In addition to *Candida albicans*, the Ascomycetes *Aspergillus flavus, Fusarium oxysporum* and the Basidiomycete *Trichosporon beigelii* were inhibited with P18 and variants of the peptide. However, the most effective inhibition was achieved with P18 (Lee et al., 2004, Biotechnology Letters, 26: 337-341). An inhibition of lipophilic fungi, in particular of the genus *Malassezia* is not taught. Furthermore, no experiments are described which demonstrate a more effective effect of cecropin-magainin fusions compared to known, commercial antifungal substances.

The genus *Malassezia* are lipophilic fungi which in part belong to the normal resident flora on human skin. Many representatives are obligatorily lipophilic, only *M. pachydermatis* is described as optionally lipophilic. Nevertheless disorders which are associated with *Malassezia* ssp. are described. These include pityriasis versicolor, atopic dermatitis, pityriasis capitis, seborrhea and *pityrosporum* folliculitis or malassezia folliculitis, for which *Malassezia* ssp. are pathogens. (Cutsem et al., 1990, Journal of the American Academy of Dermatology, 22: 993-998, Nenoff et al., 2007, Aktuelle Dermatologie, 33: 26-32). For treatment, antimycotic, fungicidal agents are usually used. Examples thereof are ketoconazole, climbazole, zinc pyrithiones, piroctone olamine, selenium sulfides or some natural extracts (e.g. like juniper oil, rosemary oil), which are often added in the single-digit %, (w/w) range, for example, in antidandruff shampoo formulations.

However, some of the described substances for inhibiting, treating or preventing dandruff are either toxicologically unacceptable, or the cosmetic preparations are not effective enough (Kosmetische Medizin 5+6/2006).

The species *Malassezia furfur* is less sensitive toward several antimycotics compared to other *Malassezia* species (Nenoff et al., 2007, Aktuelle Dermatologie, 33: 26-32). It is likewise described that substances which considerably inhibit the growth of *Candida albicans* even at low concentrations, only prevent the growth of *Malassezia furfur* at high concentrations, if at all. Thus, Nenoff et al. describe the inhibition of *Candida albicans* by phytosphingosines at concentrations of about 152-269 µg/ml whereas an inhibition of *M. furfur* only took place at approximately 25-fold higher concentrations (6250 µg/ml) for basic phytosphingosines, or *M. furfur* appeared to be resistant to phytosphingosine salts (Nenoff et al., 2002, Acta Derm Venerol, 82:170-173).

Similar observations were made for the peptide cilofungin by Hanson et al. 1989. While 76% of the *C. albicans* strains did not grow at a cilofungin concentration of 0.62 µg/ml, the obligatorily lipophilic *M. furfur* was not inhibited at these concentrations. The minimum inhibitory concentration of cilofungin for *M. furfur* was not stated. It was evidently not within the investigated range between 0.31 µg/ml and 40 µg/ml (Hanson et al., 1989, Antimicrobial agents and chemotherapy, 33:1391-1392).

In 2006, Lopez-Garcia et al. describe the growth inhibition of *M. furfur* with Cecropin P1 and magainin 2. Here, a moderate antifungal effect of cecropin P1 and a comparably better effect of magainin 2 at a concentration of 25 µM were found (Lopez-Garcia et al., 2006, Journal of Antimicrobial Chemotherapy, 57:877-882).

EP-A-0 866 804 describes the use of beta-defensins from human skin as active ingredient in cosmetic or pharmaceutical formulations. However, an internal comparison with antifungal active ingredients of the prior art is not made.

WO-A-00/032220 describes the use of a fungal polypeptide as antifungal active ingredient for the treatment of dandruff. However, an internal comparison with antifungal active ingredients of the prior art is not made here either.

US 2003/0096745 describes a polypeptide of the sequence KWKKLLKKPPPLLKKLLKKL (SEQ ID NO: 4739) with antibacterial and antifungal activity toward certain microorganisms. Antifungal activity was shown toward *Candida albicans* and *Tricosphoron beigelii*. Cosmetic applications, in particular for the treatment of dandruff, are not proposed.

However, the use of antimicrobial substances, particularly regular use, can lead to intolerance in people, or even to health damage. Intolerances may be skin reddening, irritations or sensitizations. Systemic absorption into the human body can lead to impairment of body functions. Particularly regular use of some antimicrobial substances can lead to an increase in their concentration. One known example is parabens (Dabre et al., 2004, Journal of Applied Toxicology, 24: 5-13). Depending on the application, an accumulation in the human body or in the environment may thus result.

In addition, excessive and inappropriate use of antimicrobial substances result time and again in resistance of the target organisms.

There is therefore a need to provide novel cosmetic antimicrobial compositions which firstly have antifungal effectiveness and are suitable for avoiding or treating dandruff. In particular, these should not accumulate in the body since they can be degraded in the natural surroundings.

There is in particular a need to provide antifungal active ingredients which are more effective against dandruff than the customary antidandruff agents known hitherto and in particular are effective against the dandruff fungus *Malassezia furfur* and other *Malassezia* ssp. Preferably, the natural skin flora should not be impaired, and the active ingredients should also not accumulate in the body or in the environment, but be degraded in the natural surroundings.

It was therefore an object of the present invention to provide a novel, effective but biodegradable active ingredient for avoiding, inhibiting and/or treating dandruff, in particular scurf. Advantageously, active ingredient compounds are to be identified which are suitable for producing cosmetic and/or dermatocosmetic formulations or preparations. Furthermore, systemic absorption of the active ingredient should be avoided. Additionally, it should be ensured that the preparations have low or no cytoxicity. In particular, the active ingredient should be effective against the yeast fungus *Malassezia furfur*, and also against other *Malassezia* ssp., in particular, obligatorily lipophilic species.

SUMMARY OF THE INVENTION

This object was achieved by cosmetic compositions according to the definition in the attached patent claims.

Surprisingly, it has been found that the composition comprising at least one peptide with a claimed structure or a structure motif has adequate effectiveness against lipophilic fungal species, in particular *Malassezia furfur*, associated with good skin compatibility. Furthermore, a biodegradability was found which progresses more rapidly compared to customary antidandruff active ingredients such as zinc pyrithiones. Furthermore, it has surprisingly been found that the effect is better than the effect which is achieved with the peptides cecropin A or magainin II on their own.

DETAILED DESCRIPTION OF THE INVENTION

1. General Definitions

A "helix breaker" means a section within a peptide according to the invention which, in the region of this section of the peptide chain, inhibits the formation of a helical secondary structure. The formation of a helix structure further away from the helix breaker, however, is not suppressed. Typical helix breakers are known to the person skilled in the art. In particular, the amino acid proline is a peptide building block with the property of a helix breaker. The same is true for proline-containing peptide fragments.

Within the context of the invention, "hydrophobic amino acids" are alanine, valine, leucine, isoleucine, phenylalanine, methionine and tryptophan.

Within the context of the invention, "hydrophilic amino acids" are in particular amino acids with polar side chains, such as serine, threonine, cysteine, tyrosine, asparagine and glutamine; acidic amino acids, such as aspartic acid and glutamic acid; and in particular basic amino acids, such as lysine, arginine and histidine.

"Capable of forming an alpha-helix arms" is a sequence which promotes the formation of a helical structure under suitable conditions. Artificial suitable conditions for forming helix structures are, for example, the solvent systems based on trifluoroacetic acid that promote alpha-helix formation, and also SDS.

"Percentage alpha-helicity" is understood as meaning a measurement value determined with the help of circular dichroism (CD) analysis, where the sample to be measured is obtained under standard conditions, such as, in particular, 50% (v/v) trifluoroacetic acid in 10 mM sodium phosphate buffer, pH 7.0, or 30 mM SDS in 10 mM sodium phosphate buffer, pH 7.0, using a measurement cell with 1 mm path length and at peptide concentration of 100 µg/ml. The calculation is made according to the following formula:

% helicity=$100([\Theta]-[\Theta]^0)/[\Theta]^{100}$ in which
[$\Theta$] is the experimentally determined ellipticity at 222 nm;
[$\Theta$]$^0$ is the ellipticity at 222 nm and 0% helicity and
[$\Theta$]$^{100}$ is the ellipticity at 222 nm and 100% helicity.

Suitable measurement conditions are described, for example, by Shin et al., 1999, Journal of Peptide Research, 53:82-90, to which reference is hereby expressly made.

A "repetitive sequence motif" is understood as meaning the linear arrangement of preferably identical peptide sequences which are linked together directly or indirectly, i.e. via "linker groups", as defined herein.

The terms "mutants" and "variants" are used synonymously. These are understood as meaning in particular "functional" or "functionally equivalent" modifications, as described in more detail later, which still demonstrate the desired activity and thus applicability as antidandruff peptide.

The terms "cosmetic", dermatocosmetic" or "dermatological" are likewise used synonymously.

A "fusion product" is understood as meaning the covalent or noncovalent linking of peptides and proteins ("fusion peptides") and the covalent or noncovalent linking of peptides and polymers ("fusion polymers"). The linked constituents are cleavably joined together either irreversibly or reversibly, i.e. biologically, in particular enzymatically.

2. Preferred Embodiments

The invention firstly provides a cosmetic composition comprising, in a cosmetic carrier, a peptide which comprises at least one sequence motif of the following general formula I Hel1-HB-Hel2  (I)

in which
"HB" comprises 1 to 5, in particular 1, 2 or 3, continuous amino acid residues and is a part sequence motif with the function of a helix breaker, and
"Hel1" and "Hel2" are identical or different part sequence motifs which each comprise 5 to 15, such as, for example, 6 to 12, in particular 8, 9 or 10, continuous amino acid residues which are essentially selected from hydrophilic residues and hydrophobic, in particular, basic, residues different from proline, and are in each case capable of forming an alpha-helix arm where at least one of the helix arms has, in its axial projection, i.e. in the top view corresponding to a "helical wheel" diagram, an incomplete separation into a hydrophobic, in particular basic, and hydrophilic helix half. Here, for example 1, 2, 3 or 4 positions one half of the type (hydrophobic or hydrophilic) can be occupied by amino acid residues of the other type (hydrophilic or hydrophobic, respectively).

By contrast, completely separated hydrophobic and hydrophilic helix halves would consist exclusively of hydrophobic or hydrophilic amino acid residues according to the above definition. One example of a completely hydrophilically/hydrophobically separated helix to be mentioned is the sequence motif KLKKLLKK (SEQ ID NO: 4740).

A "helix half" is not necessarily to be understood here as meaning the numerical half, i.e. half the total number of amino acids of a helix. The numerical size of two halves can differ, for example, by 1 to 3 amino acids.

The invention secondly provides a cosmetic composition comprising, in a cosmetic carrier, a peptide which comprises at least one sequence motif of the following general formula I Hel1-HB-Hel2  (I)

in which
"HB" comprises 1 to 5, in particular 1, 2 or 3, continuous amino acid residues and is a part sequence motif with the function of a helix breaker, and
"Hel1" and "Hel2" are identical or different part sequence motifs which each comprise 5 to 15, such as, for example, 6 to 12, in particular 8, 9 or 10, continuous amino acid residues which are essentially selected from hydrophilic residues and hydrophobic, in particular, basic, residues different from proline, and are in each case capable of forming an alpha-helix arm, where the peptide has a percentage alpha-helicity (% helicity) of from about 25 to 98%, such as, for example, 30 to 80% or 30 to 60%, in 50% (v/v) trifluoroacetic acid, pH 7.0; or a % helicity value of from about 10 to 70%, or 12 to 55% or 12 to 40%, in 30 mM SDS, pH 7.0, in each case determined by CD spectrometry.

The invention thirdly provides a cosmetic composition comprising, in a cosmetic carrier, at least one peptide with a sequence or a repetitive sequence motif according to SEQ ID NO: 1:

(SEQ ID NO: 1)
$X_1\ X_2K\ X_3\ X_4\ X_5KIP\ X_{10}\ KFX_6X_7\ X_8\ AX_9KF$ in which
$X_{10}$ is a peptide bond or one or two arbitrary basic or hydrophobic amino acid residues or one or two proline residues and
$X_1$ to $X_9$ are arbitrary basic amino acid residues or hydrophobic amino acid residues different from proline;
where the repetitive sequence motifs may be identical or different;
and/or mutants or derivatives thereof.

In particular, the invention provides compositions according to the above definition comprising at least one peptide with a sequence or a repetitive sequence motif according to SEQ ID NO: 2:

(SEQ ID NO: 2)
$X_1\ X_2K\ X_3\ X_4\ X_5KIP\ X_{11}\ X_{12}\ KFX_6X_7\ X_8\ AX_9KF$ in which
$X_1$ is lysine, arginine or phenylalanine,
$X_2$ is lysine or tryptophan,
$X_3$ is leucine or lysine,
$X_4$ is phenylalanine or leucine,
$X_5$ is leucine or lysine,
$X_6$ is leucine or lysine,
$X_7$ is histidine or lysine,
$X_8$ is alanine, leucine, valine or serine,
$X_9$ is leucine or lysine,
$X_{11}$ is proline or a chemical bond, and
$X_{12}$ is proline or a chemical bond,
where the repetitive sequence motifs are identical or different;
and/or mutants or derivatives thereof.

Nonlimiting examples of the above sequences or repetitive sequence motifs according to SEQ ID NO: 3 are:

| P18 | KWKLFKKIPKFLHLAKKF-NH$_2$ | (SEQ ID NO: 3) |
| RP18 | RWKLFKKIPKFLHLAKKF | (SEQ ID NO: 4) |
| KKFP18 | FKKLFKKIPKFLHAAKKF | (SEQ ID NO: 5) |
| KKLP18 | KWKLLKKIPKFKKLALKF | (SEQ ID NO: 6) |
| AP18 | KWKLFKKIPKFLHAAKKF | (SEQ ID NO: 7) |
| KFLP18 | KWKKFLKIPKFLHAAKKF | (SEQ ID NO: 8) |
| KLLP18 | KWKKLLKIPKFLHAAKKF | (SEQ ID NO: 9) | and/or a mutant or derivative thereof.

Compositions according to the invention can in particular comprise peptides with a repetitive sequence motif, where a plurality, such as, in particular, 2 to 10 or 3 to 5, of peptides of the general formula I or according to SEQ ID NO: 1 to 9 or mutants or derivatives thereof are peptidically linked together via linker groups.

Here, the "linker groups" can comprise continuous, identical or different amino acid residues, preferably selected from alanine, glycine, threonine and serine, such as, for example, GGSGGT (SEQ ID NO: 4741), GGSGGS (SEQ ID NO: 4742), or poly-alanine linkers and poly-glycine linkers, where "poly" is 2 to 10; or selected from Asp, Pro, Asn and Gly, for example Asp-Pro and Asn-Gly.

Furthermore, peptides whose C-terminal carboxyl group is amidated can be used.

The invention also provides compositions comprising an, if appropriate, cleavable fusion polypeptide of at least one cosmetic, preferably peptidic auxiliary or active ingredient and at least one peptide according to the above definition. Examples of such active ingredients are: hydrophobins, keratin binding domains, albumin, lactoferrin, avidin, antibodies, preferably, keratin-binding antibodies, binding peptides for surfaces, preferably keratin-binding peptides, silk proteins, spider silk proteins, preferably C16, collagen, fibronectin, keratin, elastin, other structural proteins, preferably hair and skin structure proteins, binding proteins for skin and hair structure proteins, enamel-building proteins, amelogenin, binding proteins of the enamel-building proteins, binding proteins of amelogenin; where these fusions may be permanent or else cleavable.

The invention also provides fusion polymers of at least one cosmetic polymer and at least one peptide according to the above definition. Examples of such polymers are: polyhydroxyalkanoates, hyaluronic acid, glucan, spheroglucan, cellulose, xanthan, polyethylene glycol, polyglycerol, polylysine and silicones, which are present as covalent or noncovalent linkages.

Furthermore, it is conceivable that the abovementioned peptides can also be present in the compositions as covalent linkage to cosmetically/pharmaceutically active ingredients, such as panthenol, bisabolol, retinol, carotenoids, protein hydrolysates.

The invention also provides compositions according to the above definition, additionally comprising at least one further cosmetic or pharmaceutical active ingredient, such as, for example, at least one antiinflammatory active ingredient, an antimicrobial active ingredient for inhibiting the growth and/or the pathophysiological activity of undesired germs, such as, in particular, *Malasezzia furfur*, and/or a sebum-regulating active ingredient.

Examples of antiinflammatory active ingredients are: corticoids (e.g. cortisone), azathioprin, bisabolol, cyclosporin A, acetylsalicylic acid, ibuprofen, panthenol, camomile extract or aloe extracts, etc.

Examples of antimicrobial agents are: customary preservatives known to the person skilled in the art, such as alcohols, p-hydroxybenzoic acid esters, imidazolinylurea, formaldehyde, sorbic acid, benzoic acid, salicylic acid, etc. Such deodorizing substances are, for example, zinc ricinoleate, triclosan, undecylenic acid alkylolamides, triethyl citrate, chlorhexidine, etc. (cf. also section 3.5 below). They also include azoles (Ketoconazole, climbazole), zinc pyrithione, selenium sulfides, etc.

Examples of sebum-regulating active ingredients are: azelaic acid, sebacic acid, potassiumalezaoyldiglycinate, 10-hydroxydecanoic acid, 1,10-decanediol, aluminium salts, like aluminiumchlorohydrate, etc.

The peptide is present in the compositions according to the invention in a fraction of from 0.0001 to 50% by weight, in particular 0.001 to 10% by weight, and especially 0.005 to 0.1% by weight, in each case based on the total weight of the finished composition.

A further aspect of the present invention relates to compositions containing at least one peptide as defined above which shows for *Malassezia furfur* a minimal inhibitory concentration of about 1500 to 0.1 µM, as for example 500 to 1 µM, 100 to 5 µM or 50 to 10 µM, as determined under standard conditions. Standard conditions in this context relate to a *Malassezia furfur* culture, which shows an initial optical density of 0.1 at 600 nm, and which, after a 24 hour incubation with said peptide, which is contained at said minimum concentration in said culture medium, contains less than one colony-forming unit (CFU) of said microorganism per µl culture medium.

The invention further provides the use of a peptide according to the above definition or of a fusion polypeptide according to the above definition, optionally in combination with at least one further conventional, as for example low-molecular weight, antifungal agent, as for example Ketoconazole, Climbazole, Zincpyrithione or selenosulfides, for producing a cosmetic composition for the treatment or prevention of dandruff, in particular scurf, where the peptide is used in particular for suppressing the growth and/or the pathophysiological activity of lipophilic fungi, in particular *Malassezia furfur* and other species of the genus *Malassezia*, or for producing cosmetic compositions in which the peptide is present as preservative.

In this connection, various natural skin organisms are essentially not or only slightly inhibited in their growth and/or activity during the dandruff treatment.

The invention further provides a method of producing a cosmetic composition according to the above definition, where a peptide according to the above definition is formulated together with at least one customary cosmetic auxiliary and, if appropriate, further cosmetic or pharmaceutical active ingredients to give the desired administration form.

The invention further provides peptides according to the above definition and also nucleic acids coding for such peptides, and also complementary nucleic acids which hybridize with such coding nucleic acids under stringent conditions.

Furthermore, the invention relates to screening methods for antidandruff peptides, where, using a complementary nucleic acid according to the above definition as probe, a nucleic-acid-containing sample is screened for hybridizing sequences using the probe under stringent conditions.

Finally, the invention provides a dispensing system for releasing a peptide according to the above definition, where the peptide and, if appropriate, further ingredients present are associated with liposomes, zeolites, cyclodextrins, polyethyleneimine-based vector systems, which are, for example, present (dissolved, suspended, dispersed) therein.

P18 (SEQ ID NO: 3) is a peptide with a chain length of 18 amino acids which is derived from a fusion peptide from fragments of cecropin A from *Hyalaphora cecropia* and magainin from *Xenopus laevis*. Fungicidal activity was found for *Candida albicans, Trichosporon beigelii, Aspergillus flavus* and *Fusarium oxysporum* in experiments (Lee et al., (2004) Biotechnology Letters, 26:337-341.). However, the person skilled in the art is aware that the effect of fungicidal substances on different organisms can be very different. Particularly the effect on the lipophilic fungus *Malassezia furfur* and the lipophilic species of the genus *Malassezia* can differ for example significantly from the effect on *Candida albicans* (Hanson et al., (1989) Antimicrobial Agents and Chemotherapy, 33:1391-1392; Nenhoff et al., (2002) Acta Derm Venereol., 82:170-173). The effect of P18 observed according to the invention and structurally and functionally related peptides of the species described herein is therefore completely surprising to the person skilled in the art.

In a further particular embodiment, the secondary structure of the peptides according to the invention is a helix which is divided in the middle into two helices by a helix-breaking amino acid. In a depiction as "helical wheel", hydrophobic amino acids, in particular leucine residues, predominate on one side (or half of the helix), and positively charged amino acids, in particular lysine residues, predominate on the other side.

The peptides according to the invention are composed in particular of D- and/or L-amino acids, in particular L-amino acids.

The peptides described herein and/or derivatives thereof can be produced in a manner known per se, such as through chemical solid-phase synthesis, liquid synthesis or biotechnologically using recombinant production strains or cell cultures.

3. Further Embodiments of the Invention

3.1 Examples of Further Suitable Sequence Motifs

```
3.1.1 Sequence motif
X1 X2K X3 X4 X5KIP X11 X12 KFX6X7 X8 AX9KF
(SEQ ID NO: 2)
variant_0      KKKLFLKIPPPKFLHAALKF    seqid_11
variant_1      RKKLFLKIPPPKFLHAALKF    seqid_12
variant_2      FKKLFLKIPPPKFLHAALKF    seqid_13
variant_3      KWKLFLKIPPPKFLHAALKF    seqid_14
variant_4      RWKLFLKIPPPKFLHAALKF    seqid_15
variant_5      FWKLFLKIPPPKFLHAALKF    seqid_16
variant_6      KKKKFLKIPPPKFLHAALKF    seqid_17
variant_7      RKKKFLKIPPPKFLHAALKF    seqid_18
variant_8      FKKKFLKIPPPKFLHAALKF    seqid_19
variant_9      KWKKFLKIPPPKFLHAALKF    seqid_20
variant_10     RWKKFLKIPPPKFLHAALKF    seqid_21
variant_11     FWKKFLKIPPPKFLHAALKF    seqid_22
variant_12     KKKLLLKIPPPKFLHAALKF    seqid_23
variant_13     RKKLLLKIPPPKFLHAALKF    seqid_24
variant_14     FKKLLLKIPPPKFLHAALKF    seqid_25
variant_15     KWKLLLKIPPPKFLHAALKF    seqid_26
variant_16     RWKLLLKIPPPKFLHAALKF    seqid_27
variant_17     FWKLLLKIPPPKFLHAALKF    seqid_28
variant_18     KKKKLLKIPPPKFLHAALKF    seqid_29
variant_19     RKKKLLKIPPPKFLHAALKF    seqid_30
variant_20     FKKKLLKIPPPKFLHAALKF    seqid_31
variant_21     KWKKLLKIPPPKFLHAALKF    seqid_32
variant_22     RWKKLLKIPPPKFLHAALKF    seqid_33
variant_23     FWKKLLKIPPPKFLHAALKF    seqid_34
variant_24     KKKLFKKIPPPKFLHAALKF    seqid_35
variant_25     RKKLFKKIPPPKFLHAALKF    seqid_36
variant_26     FKKLFKKIPPPKFLHAALKF    seqid_37
variant_27     KWKLFKKIPPPKFLHAALKF    seqid_38
variant_28     RWKLFKKIPPPKFLHAALKF    seqid_39
variant_29     FWKLFKKIPPPKFLHAALKF    seqid_40
variant_30     KKKKFKKIPPPKFLHAALKF    seqid_41
variant_31     RKKKFKKIPPPKFLHAALKF    seqid_42
variant_32     FKKKFKKIPPPKFLHAALKF    seqid_43
variant_33     KWKKFKKIPPPKFLHAALKF    seqid_44
variant_34     RWKKFKKIPPPKFLHAALKF    seqid_45
variant_35     FWKKFKKIPPPKFLHAALKF    seqid_46
variant_36     KKKLLKKIPPPKFLHAALKF    seqid_47
variant_37     RKKLLKKIPPPKFLHAALKF    seqid_48
variant_38     FKKLLKKIPPPKFLHAALKF    seqid_49
variant_39     KWKLLKKIPPPKFLHAALKF    seqid_50
variant_40     RWKLLKKIPPPKFLHAALKF    seqid_51
variant_41     FWKLLKKIPPPKFLHAALKF    seqid_52
variant_42     KKKKLKKIPPPKFLHAALKF    seqid_53
variant_43     RKKKLKKIPPPKFLHAALKF    seqid_54
variant_44     FKKKLKKIPPPKFLHAALKF    seqid_55
variant_45     KWKKLKKIPPPKFLHAALKF    seqid_56
variant_46     RWKKLKKIPPPKFLHAALKF    seqid_57
variant_47     FWKKLKKIPPPKFLHAALKF    seqid_58
variant_48     KKKLFLKIPPKFLHAALKF     seqid_59
variant_49     RKKLFLKIPPKFLHAALKF     seqid_60
variant_50     FKKLFLKIPPKFLHAALKF     seqid_61
variant_51     KWKLFLKIPPKFLHAALKF     seqid_62
variant_52     RWKLFLKIPPKFLHAALKF     seqid_63
variant_53     FWKLFLKIPPKFLHAALKF     seqid_64
variant_54     KKKKFLKIPPKFLHAALKF     seqid_65
variant_55     RKKKFLKIPPKFLHAALKF     seqid_66
variant_56     FKKKFLKIPPKFLHAALKF     seqid_67
variant_57     KWKKFLKIPPKFLHAALKF     seqid_68
variant_58     RWKKFLKIPPKFLHAALKF     seqid_69
variant_59     FWKKFLKIPPKFLHAALKF     seqid_70
variant_60     KKKLLLKIPPKFLHAALKF     seqid_71
variant_61     RKKLLLKIPPKFLHAALKF     seqid_72
variant_62     FKKLLLKIPPKFLHAALKF     seqid_73
variant_63     KWKLLLKIPPKFLHAALKF     seqid_74
variant_64     RWKLLLKIPPKFLHAALKF     seqid_75
```

-continued

| | | |
|---|---|---|
| variant_65 | FWKLLLKIPPKFLHAALKF | seqid_76 |
| variant_66 | KKKKLLKIPPKFLHAALKF | seqid_77 |
| variant_67 | RKKKLLKIPPKFLHAALKF | seqid_78 |
| variant_68 | FKKKLLKIPPKFLHAALKF | seqid_79 |
| variant_69 | KWKKLLKIPPKFLHAALKF | seqid_80 |
| variant_70 | RWKKLLKIPPKFLHAALKF | seqid_81 |
| variant_71 | FWKKLLKIPPKFLHAALKF | seqid_82 |
| variant_72 | KKKLFKKIPPKFLHAALKF | seqid_83 |
| variant_73 | RKKLFKKIPPKFLHAALKF | seqid_84 |
| variant_74 | FKKLFKKIPPKFLHAALKF | seqid_85 |
| variant_75 | KWKLFKKIPPKFLHAALKF | seqid_86 |
| variant_76 | RWKLFKKIPPKFLHAALKF | seqid_87 |
| variant_77 | FWKLFKKIPPKFLHAALKF | seqid_88 |
| variant_78 | KKKKFKKIPPKFLHAALKF | seqid_89 |
| variant_79 | RKKKFKKIPPKFLHAALKF | seqid_90 |
| variant_80 | FKKKFKKIPPKFLHAALKF | seqid_91 |
| variant_81 | KWKKFKKIPPKFLHAALKF | seqid_92 |
| variant_82 | RWKKFKKIPPKFLHAALKF | seqid_93 |
| variant_83 | FWKKFKKIPPKFLHAALKF | seqid_94 |
| variant_84 | KKKLLKKIPPKFLHAALKF | seqid_95 |
| variant_85 | RKKLLKKIPPKFLHAALKF | seqid_96 |
| variant_86 | FKKLLKKIPPKFLHAALKF | seqid_97 |
| variant_87 | KWKLLKKIPPKFLHAALKF | seqid_98 |
| variant_88 | RWKLLKKIPPKFLHAALKF | seqid_99 |
| variant_89 | FWKLLKKIPPKFLHAALKF | seqid_100 |
| variant_90 | KKKKLKKIPPKFLHAALKF | seqid_101 |
| variant_91 | RKKKLKKIPPKFLHAALKF | seqid_102 |
| variant_92 | FKKKLKKIPPKFLHAALKF | seqid_103 |
| variant_93 | KWKKLKKIPPKFLHAALKF | seqid_104 |
| variant_94 | RWKKLKKIPPKFLHAALKF | seqid_105 |
| variant_95 | FWKKLKKIPPKFLHAALKF | seqid_106 |
| variant_144 | KKKLFLKIPKFLHAALKF | seqid_107 |
| variant_145 | RKKLFLKIPKFLHAALKF | seqid_108 |
| variant_146 | FKKLFLKIPKFLHAALKF | seqid_109 |
| variant_147 | KWKLFLKIPKFLHAALKF | seqid_110 |
| variant_148 | RWKLFLKIPKFLHAALKF | seqid_111 |
| variant_149 | FWKLFLKIPKFLHAALKF | seqid_112 |
| variant_150 | KKKKFLKIPKFLHAALKF | seqid_113 |
| variant_151 | RKKKFLKIPKFLHAALKF | seqid_114 |
| variant_152 | FKKKFLKIPKFLHAALKF | seqid_115 |
| variant_153 | KWKKFLKIPKFLHAALKF | seqid_116 |
| variant_154 | RWKKFLKIPKFLHAALKF | seqid_117 |
| variant_155 | FWKKFLKIPKFLHAALKF | seqid_118 |
| variant_156 | KKKLLLKIPKFLHAALKF | seqid_119 |
| variant_157 | RKKLLLKIPKFLHAALKF | seqid_120 |
| variant_158 | FKKLLLKIPKFLHAALKF | seqid_121 |
| variant_159 | KWKLLLKIPKFLHAALKF | seqid_122 |
| variant_160 | RWKLLLKIPKFLHAALKF | seqid_123 |
| variant_161 | FWKLLLKIPKFLHAALKF | seqid_124 |
| variant_162 | KKKKLLKIPKFLHAALKF | seqid_125 |
| variant_163 | RKKKLLKIPKFLHAALKF | seqid_126 |
| variant_164 | FKKKLLKIPKFLHAALKF | seqid_127 |
| variant_165 | KWKKLLKIPKFLHAALKF | seqid_128 |
| variant_166 | RWKKLLKIPKFLHAALKF | seqid_129 |
| variant_167 | FWKKLLKIPKFLHAALKF | seqid_130 |
| variant_168 | KKKLFKKIPKFLHAALKF | seqid_131 |
| variant_169 | RKKLFKKIPKFLHAALKF | seqid_132 |
| variant_170 | FKKLFKKIPKFLHAALKF | seqid_133 |
| variant_171 | KWKLFKKIPKFLHAALKF | seqid_134 |
| variant_172 | RWKLFKKIPKFLHAALKF | seqid_135 |
| variant_173 | FWKLFKKIPKFLHAALKF | seqid_136 |
| variant_174 | KKKKFKKIPKFLHAALKF | seqid_137 |
| variant_175 | RKKKFKKIPKFLHAALKF | seqid_138 |
| variant_176 | FKKKFKKIPKFLHAALKF | seqid_139 |
| variant_177 | KWKKFKKIPKFLHAALKF | seqid_140 |
| variant_178 | RWKKFKKIPKFLHAALKF | seqid_141 |
| variant_179 | FWKKFKKIPKFLHAALKF | seqid_142 |
| variant_180 | KKKLLKKIPKFLHAALKF | seqid_143 |
| variant_181 | RKKLLKKIPKFLHAALKF | seqid_144 |
| variant_182 | FKKLLKKIPKFLHAALKF | seqid_145 |
| variant_183 | KWKLLKKIPKFLHAALKF | seqid_146 |
| variant_184 | RWKLLKKIPKFLHAALKF | seqid_147 |
| variant_185 | FWKLLKKIPKFLHAALKF | seqid_148 |
| variant_186 | KKKKLKKIPKFLHAALKF | seqid_149 |
| variant_187 | RKKKLKKIPKFLHAALKF | seqid_150 |
| variant_188 | FKKKLKKIPKFLHAALKF | seqid_151 |
| variant_189 | KWKKLKKIPKFLHAALKF | seqid_152 |
| variant_190 | RWKKLKKIPKFLHAALKF | seqid_153 |
| variant_191 | FWKKLKKIPKFLHAALKF | seqid_154 |
| variant_192 | KKKLFLKIPPPKFKHAALKF | seqid_155 |
| variant_193 | RKKLFLKIPPPKFKHAALKF | seqid_156 |

| | | |
|---|---|---|
| variant_194 | FKKLFLKIPPPKFKHAALKF | seqid_157 |
| variant_195 | KWKLFLKIPPPKFKHAALKF | seqid_158 |
| variant_196 | RWKLFLKIPPPKFKHAALKF | seqid_159 |
| variant_197 | FWKLFLKIPPPKFKHAALKF | seqid_160 |
| variant_198 | KKKKFLKIPPPKFKHAALKF | seqid_161 |
| variant_199 | RKKKFLKIPPPKFKHAALKF | seqid_162 |
| variant_200 | FKKKFLKIPPPKFKHAALKF | seqid_163 |
| variant_201 | KWKKFLKIPPPKFKHAALKF | seqid_164 |
| variant_202 | RWKKFLKIPPPKFKHAALKF | seqid_165 |
| variant_203 | FWKKFLKIPPPKFKHAALKF | seqid_166 |
| variant_204 | KKKLLLKIPPPKFKHAALKF | seqid_167 |
| variant_205 | RKKLLLKIPPPKFKHAALKF | seqid_168 |
| variant_206 | FKKLLLKIPPPKFKHAALKF | seqid_169 |
| variant_207 | KWKLLLKIPPPKFKHAALKF | seqid_170 |
| variant_208 | RWKLLLKIPPPKFKHAALKF | seqid_171 |
| variant_209 | FWKLLLKIPPPKFKHAALKF | seqid_172 |
| variant_210 | KKKKLLKIPPPKFKHAALKF | seqid_173 |
| variant_211 | RKKKLLKIPPPKFKHAALKF | seqid_174 |
| variant_212 | FKKKLLKIPPPKFKHAALKF | seqid_175 |
| variant_213 | KWKKLLKIPPPKFKHAALKF | seqid_176 |
| variant_214 | RWKKLLKIPPPKFKHAALKF | seqid_177 |
| variant_215 | FWKKLLKIPPPKFKHAALKF | seqid_178 |
| variant_216 | KKKLFKKIPPPKFKHAALKF | seqid_179 |
| variant_217 | RKKLFKKIPPPKFKHAALKF | seqid_180 |
| variant_218 | FKKLFKKIPPPKFKHAALKF | seqid_181 |
| variant_219 | KWKLFKKIPPPKFKHAALKF | seqid_182 |
| variant_220 | RWKLFKKIPPPKFKHAALKF | seqid_183 |
| variant_221 | FWKLFKKIPPPKFKHAALKF | seqid_184 |
| variant_222 | KKKKFKKIPPPKFKHAALKF | seqid_185 |
| variant_223 | RKKKFKKIPPPKFKHAALKF | seqid_186 |
| variant_224 | FKKKFKKIPPPKFKHAALKF | seqid_187 |
| variant_225 | KWKKFKKIPPPKFKHAALKF | seqid_188 |
| variant_226 | RWKKFKKIPPPKFKHAALKF | seqid_189 |
| variant_227 | FWKKFKKIPPPKFKHAALKF | seqid_190 |
| variant_228 | KKKLLKKIPPPKFKHAALKF | seqid_191 |
| variant_229 | RKKLLKKIPPPKFKHAALKF | seqid_192 |
| variant_230 | FKKLLKKIPPPKFKHAALKF | seqid_193 |
| variant_231 | KWKLLKKIPPPKFKHAALKF | seqid_194 |
| variant_232 | RWKLLKKIPPPKFKHAALKF | seqid_195 |
| variant_233 | FWKLLKKIPPPKFKHAALKF | seqid_196 |
| variant_234 | KKKKLKKIPPPKFKHAALKF | seqid_197 |
| variant_235 | RKKKLKKIPPPKFKHAALKF | seqid_198 |
| variant_236 | FKKKLKKIPPPKFKHAALKF | seqid_199 |
| variant_237 | KWKKLKKIPPPKFKHAALKF | seqid_200 |
| variant_238 | RWKKLKKIPPPKFKHAALKF | seqid_201 |
| variant_239 | FWKKLKKIPPPKFKHAALKF | seqid_202 |
| variant_240 | KKKLFLKIPPKFKHAALKF | seqid_203 |
| variant_241 | RKKLFLKIPPKFKHAALKF | seqid_204 |
| variant_242 | FKKLFLKIPPKFKHAALKF | seqid_205 |
| variant_243 | KWKLFLKIPPKFKHAALKF | seqid_206 |
| variant_244 | RWKLFLKIPPKFKHAALKF | seqid_207 |
| variant_245 | FWKLFLKIPPKFKHAALKF | seqid_208 |
| variant_246 | KKKKFLKIPPKFKHAALKF | seqid_209 |
| variant_247 | RKKKFLKIPPKFKHAALKF | seqid_210 |
| variant_248 | FKKKFLKIPPKFKHAALKF | seqid_211 |
| variant_249 | KWKKFLKIPPKFKHAALKF | seqid_212 |
| variant_250 | RWKKFLKIPPKFKHAALKF | seqid_213 |
| variant_251 | FWKKFLKIPPKFKHAALKF | seqid_214 |
| variant_252 | KKKLLLKIPPKFKHAALKF | seqid_215 |
| variant_253 | RKKLLLKIPPKFKHAALKF | seqid_216 |
| variant_254 | FKKLLLKIPPKFKHAALKF | seqid_217 |
| variant_255 | KWKLLLKIPPKFKHAALKF | seqid_218 |
| variant_256 | RWKLLLKIPPKFKHAALKF | seqid_219 |
| variant_257 | FWKLLLKIPPKFKHAALKF | seqid_220 |
| variant_258 | KKKKLLKIPPKFKHAALKF | seqid_221 |
| variant_259 | RKKKLLKIPPKFKHAALKF | seqid_222 |
| variant_260 | FKKKLLKIPPKFKHAALKF | seqid_223 |
| variant_261 | KWKKLLKIPPKFKHAALKF | seqid_224 |
| variant_262 | RWKKLLKIPPKFKHAALKF | seqid_225 |
| variant_263 | FWKKLLKIPPKFKHAALKF | seqid_226 |
| variant_264 | KKKLFKKIPPKFKHAALKF | seqid_227 |
| variant_265 | RKKLFKKIPPKFKHAALKF | seqid_228 |
| variant_266 | FKKLFKKIPPKFKHAALKF | seqid_229 |
| variant_267 | KWKLFKKIPPKFKHAALKF | seqid_230 |
| variant_268 | RWKLFKKIPPKFKHAALKF | seqid_231 |
| variant_269 | FWKLFKKIPPKFKHAALKF | seqid_232 |
| variant_270 | KKKKFKKIPPKFKHAALKF | seqid_233 |
| variant_271 | RKKKFKKIPPKFKHAALKF | seqid_234 |
| variant_272 | FKKKFKKIPPKFKHAALKF | seqid_235 |
| variant_273 | KWKKFKKIPPKFKHAALKF | seqid_236 |
| variant_274 | RWKKFKKIPPKFKHAALKF | seqid_237 |

| | | |
|---|---|---|
| variant_275 | FWKKFKKIPPKFKHAALKF | seqid_238 |
| variant_276 | KKKLLKKIPPKFKHAALKF | seqid_239 |
| variant_277 | RKKLLKKIPPKFKHAALKF | seqid_240 |
| variant_278 | FKKLLKKIPPKFKHAALKF | seqid_241 |
| variant_279 | KWKLLKKIPPKFKHAALKF | seqid_242 |
| variant_280 | RWKLLKKIPPKFKHAALKF | seqid_243 |
| variant_281 | FWKLLKKIPPKFKHAALKF | seqid_244 |
| variant_282 | KKKKLKKIPPKFKHAALKF | seqid_245 |
| variant_283 | RKKKLKKIPPKFKHAALKF | seqid_246 |
| variant_284 | FKKKLKKIPPKFKHAALKF | seqid_247 |
| variant_285 | KWKKLKKIPPKFKHAALKF | seqid_248 |
| variant_286 | RWKKLKKIPPKFKHAALKF | seqid_249 |
| variant_287 | FWKKLKKIPPKFKHAALKF | seqid_250 |
| variant_336 | KKKLFLKIPKFKHAALKF | seqid_251 |
| variant_337 | RKKLFLKIPKFKHAALKF | seqid_252 |
| variant_338 | FKKLFLKIPKFKHAALKF | seqid_253 |
| variant_339 | KWKLFLKIPKFKHAALKF | seqid_254 |
| variant_340 | RWKLFLKIPKFKHAALKF | seqid_255 |
| variant_341 | FWKLFLKIPKFKHAALKF | seqid_256 |
| variant_342 | KKKKFLKIPKFKHAALKF | seqid_257 |
| variant_343 | RKKKFLKIPKFKHAALKF | seqid_258 |
| variant_344 | FKKKFLKIPKFKHAALKF | seqid_259 |
| variant_345 | KWKKFLKIPKFKHAALKF | seqid_260 |
| variant_346 | RWKKFLKIPKFKHAALKF | seqid_261 |
| variant_347 | FWKKFLKIPKFKHAALKF | seqid_262 |
| variant_348 | KKKLLLKIPKFKHAALKF | seqid_263 |
| variant_349 | RKKLLLKIPKFKHAALKF | seqid_264 |
| variant_350 | FKKLLLKIPKFKHAALKF | seqid_265 |
| variant_351 | KWKLLLKIPKFKHAALKF | seqid_266 |
| variant_352 | RWKLLLKIPKFKHAALKF | seqid_267 |
| variant_353 | FWKLLLKIPKFKHAALKF | seqid_268 |
| variant_354 | KKKKLLKIPKFKHAALKF | seqid_269 |
| variant_355 | RKKKLLKIPKFKHAALKF | seqid_270 |
| variant_356 | FKKKLLKIPKFKHAALKF | seqid_271 |
| variant_357 | KWKKLLKIPKFKHAALKF | seqid_272 |
| variant_358 | RWKKLLKIPKFKHAALKF | seqid_273 |
| variant_359 | FWKKLLKIPKFKHAALKF | seqid_274 |
| variant_360 | KKKLFKKIPKFKHAALKF | seqid_275 |
| variant_361 | RKKLFKKIPKFKHAALKF | seqid_276 |
| variant_362 | FKKLFKKIPKFKHAALKF | seqid_277 |
| variant_363 | KWKLFKKIPKFKHAALKF | seqid_278 |
| variant_364 | RWKLFKKIPKFKHAALKF | seqid_279 |
| variant_365 | FWKLFKKIPKFKHAALKF | seqid_280 |
| variant_366 | KKKKFKKIPKFKHAALKF | seqid_281 |
| variant_367 | RKKKFKKIPKFKHAALKF | seqid_282 |
| variant_368 | FKKKFKKIPKFKHAALKF | seqid_283 |
| variant_369 | KWKKFKKIPKFKHAALKF | seqid_284 |
| variant_370 | RWKKFKKIPKFKHAALKF | seqid_285 |
| variant_371 | FWKKFKKIPKFKHAALKF | seqid_286 |
| variant_372 | KKKLLKKIPKFKHAALKF | seqid_287 |
| variant_373 | RKKLLKKIPKFKHAALKF | seqid_288 |
| variant_374 | FKKLLKKIPKFKHAALKF | seqid_289 |
| variant_375 | KWKLLKKIPKFKHAALKF | seqid_290 |
| variant_376 | RWKLLKKIPKFKHAALKF | seqid_291 |
| variant_377 | FWKLLKKIPKFKHAALKF | seqid_292 |
| variant_378 | KKKKLKKIPKFKHAALKF | seqid_293 |
| variant_379 | RKKKLKKIPKFKHAALKF | seqid_294 |
| variant_380 | FKKKLKKIPKFKHAALKF | seqid_295 |
| variant_381 | KWKKLKKIPKFKHAALKF | seqid_296 |
| variant_382 | RWKKLKKIPKFKHAALKF | seqid_297 |
| variant_383 | FWKKLKKIPKFKHAALKF | seqid_298 |
| variant_384 | KKKLFLKIPPPKFLKAALKF | seqid_299 |
| variant_385 | RKKLFLKIPPPKFLKAALKF | seqid_300 |
| variant_386 | FKKLFLKIPPPKFLKAALKF | seqid_301 |
| variant_387 | KWKLFLKIPPPKFLKAALKF | seqid_302 |
| variant_388 | RWKLFLKIPPPKFLKAALKF | seqid_303 |
| variant_389 | FWKLFLKIPPPKFLKAALKF | seqid_304 |
| variant_390 | KKKKFLKIPPPKFLKAALKF | seqid_305 |
| variant_391 | RKKKFLKIPPPKFLKAALKF | seqid_306 |
| variant_392 | FKKKFLKIPPPKFLKAALKF | seqid_307 |
| variant_393 | KWKKFLKIPPPKFLKAALKF | seqid_308 |
| variant_394 | RWKKFLKIPPPKFLKAALKF | seqid_309 |
| variant_395 | FWKKFLKIPPPKFLKAALKF | seqid_310 |
| variant_396 | KKKLLLKIPPPKFLKAALKF | seqid_311 |
| variant_397 | RKKLLLKIPPPKFLKAALKF | seqid_312 |
| variant_398 | FKKLLLKIPPPKFLKAALKF | seqid_313 |
| variant_399 | KWKLLLKIPPPKFLKAALKF | seqid_314 |
| variant_400 | RWKLLLKIPPPKFLKAALKF | seqid_315 |
| variant_401 | FWKLLLKIPPPKFLKAALKF | seqid_316 |
| variant_402 | KKKKLLKIPPPKFLKAALKF | seqid_317 |
| variant_403 | RKKKLLKIPPPKFLKAALKF | seqid_318 |

| | | |
|---|---|---|
| variant_404 | FKKKLLLKIPPPKFLKAALKF | seqid_319 |
| variant_405 | KWKKLLLKIPPPKFLKAALKF | seqid_320 |
| variant_406 | RWKKLLLKIPPPKFLKAALKF | seqid_321 |
| variant_407 | FWKKLLLKIPPPKFLKAALKF | seqid_322 |
| variant_408 | KKKLFKKIPPPKFLKAALKF | seqid_323 |
| variant_409 | RKKLFKKIPPPKFLKAALKF | seqid_324 |
| variant_410 | FKKLFKKIPPPKFLKAALKF | seqid_325 |
| variant_411 | KWKLFKKIPPPKFLKAALKF | seqid_326 |
| variant_412 | RWKLFKKIPPPKFLKAALKF | seqid_327 |
| variant_413 | FWKLFKKIPPPKFLKAALKF | seqid_328 |
| variant_414 | KKKKFKKIPPPKFLKAALKF | seqid_329 |
| variant_415 | RKKKFKKIPPPKFLKAALKF | seqid_330 |
| variant_416 | FKKKFKKIPPPKFLKAALKF | seqid_331 |
| variant_417 | KWKKFKKIPPPKFLKAALKF | seqid_332 |
| variant_418 | RWKKFKKIPPPKFLKAALKF | seqid_333 |
| variant_419 | FWKKFKKIPPPKFLKAALKF | seqid_334 |
| variant_420 | KKKLLKKIPPPKFLKAALKF | seqid_335 |
| variant_421 | RKKLLKKIPPPKFLKAALKF | seqid_336 |
| variant_422 | FKKLLKKIPPPKFLKAALKF | seqid_337 |
| variant_423 | KWKLLKKIPPPKFLKAALKF | seqid_338 |
| variant_424 | RWKLLKKIPPPKFLKAALKF | seqid_339 |
| variant_425 | FWKLLKKIPPPKFLKAALKF | seqid_340 |
| variant_426 | KKKKLKKIPPPKFLKAALKF | seqid_341 |
| variant_427 | RKKKLKKIPPPKFLKAALKF | seqid_342 |
| variant_428 | FKKKLKKIPPPKFLKAALKF | seqid_343 |
| variant_429 | KWKKLKKIPPPKFLKAALKF | seqid_344 |
| variant_430 | RWKKLKKIPPPKFLKAALKF | seqid_345 |
| variant_431 | FWKKLKKIPPPKFLKAALKF | seqid_346 |
| variant_432 | KKKLFLKIPPKFLKAALKF | seqid_347 |
| variant_433 | RKKLFLKIPPKFLKAALKF | seqid_348 |
| variant_434 | FKKLFLKIPPKFLKAALKF | seqid_349 |
| variant_435 | KWKLFLKIPPKFLKAALKF | seqid_350 |
| variant_436 | RWKLFLKIPPKFLKAALKF | seqid_351 |
| variant_437 | FWKLFLKIPPKFLKAALKF | seqid_352 |
| variant_438 | KKKKFLKIPPKFLKAALKF | seqid_353 |
| variant_439 | RKKKFLKIPPKFLKAALKF | seqid_354 |
| variant_440 | FKKKFLKIPPKFLKAALKF | seqid_355 |
| variant_441 | KWKKFLKIPPKFLKAALKF | seqid_356 |
| variant_442 | RWKKFLKIPPKFLKAALKF | seqid_357 |
| variant_443 | FWKKFLKIPPKFLKAALKF | seqid_358 |
| variant_444 | KKKLLLKIPPKFLKAALKF | seqid_359 |
| variant_445 | RKKLLLKIPPKFLKAALKF | seqid_360 |
| variant_446 | FKKLLLKIPPKFLKAALKF | seqid_361 |
| variant_447 | KWKLLLKIPPKFLKAALKF | seqid_362 |
| variant_448 | RWKLLLKIPPKFLKAALKF | seqid_363 |
| variant_449 | FWKLLLKIPPKFLKAALKF | seqid_364 |
| variant_450 | KKKKLLKIPPKFLKAALKF | seqid_365 |
| variant_451 | RKKKLLKIPPKFLKAALKF | seqid_366 |
| variant_452 | FKKKLLKIPPKFLKAALKF | seqid_367 |
| variant_453 | KWKKLLKIPPKFLKAALKF | seqid_368 |
| variant_454 | RWKKLLKIPPKFLKAALKF | seqid_369 |
| variant_455 | FWKKLLKIPPKFLKAALKF | seqid_370 |
| variant_456 | KKKLFKKIPPKFLKAALKF | seqid_371 |
| variant_457 | RKKLFKKIPPKFLKAALKF | seqid_372 |
| variant_458 | FKKLFKKIPPKFLKAALKF | seqid_373 |
| variant_459 | KWKLFKKIPPKFLKAALKF | seqid_374 |
| variant_460 | RWKLFKKIPPKFLKAALKF | seqid_375 |
| variant_461 | FWKLFKKIPPKFLKAALKF | seqid_376 |
| variant_462 | KKKKFKKIPPKFLKAALKF | seqid_377 |
| variant_463 | RKKKFKKIPPKFLKAALKF | seqid_378 |
| variant_464 | FKKKFKKIPPKFLKAALKF | seqid_379 |
| variant_465 | KWKKFKKIPPKFLKAALKF | seqid_380 |
| variant_466 | RWKKFKKIPPKFLKAALKF | seqid_381 |
| variant_467 | FWKKFKKIPPKFLKAALKF | seqid_382 |
| variant_468 | KKKLLKKIPPKFLKAALKF | seqid_383 |
| variant_469 | RKKLLKKIPPKFLKAALKF | seqid_384 |
| variant_470 | FKKLLKKIPPKFLKAALKF | seqid_385 |
| variant_471 | KWKLLKKIPPKFLKAALKF | seqid_386 |
| variant_472 | RWKLLKKIPPKFLKAALKF | seqid_387 |
| variant_473 | FWKLLKKIPPKFLKAALKF | seqid_388 |
| variant_474 | KKKKLKKIPPKFLKAALKF | seqid_389 |
| variant_475 | RKKKLKKIPPKFLKAALKF | seqid_390 |
| variant_476 | FKKKLKKIPPKFLKAALKF | seqid_391 |
| variant_477 | KWKKLKKIPPKFLKAALKF | seqid_392 |
| variant_478 | RWKKLKKIPPKFLKAALKF | seqid_393 |
| variant_479 | FWKKLKKIPPKFLKAALKF | seqid_394 |
| variant_528 | KKKLFLKIPKFLKAALKF | seqid_395 |
| variant_529 | RKKLFLKIPKFLKAALKF | seqid_396 |
| variant_530 | FKKLFLKIPKFLKAALKF | seqid_397 |
| variant_531 | KWKLFLKIPKFLKAALKF | seqid_398 |
| variant_532 | RWKLFLKIPKFLKAALKF | seqid_399 |

| variant_533 | FWKLFLKIPKFLKAALKF | seqid_400 |
| variant_534 | KKKKFLKIPKFLKAALKF | seqid_401 |
| variant_535 | RKKKFLKIPKFLKAALKF | seqid_402 |
| variant_536 | FKKKFLKIPKFLKAALKF | seqid_403 |
| variant_537 | KWKKFLKIPKFLKAALKF | seqid_404 |
| variant_538 | RWKKFLKIPKFLKAALKF | seqid_405 |
| variant_539 | FWKKFLKIPKFLKAALKF | seqid_406 |
| variant_540 | KKKLLLKIPKFLKAALKF | seqid_407 |
| variant_541 | RKKLLLKIPKFLKAALKF | seqid_408 |
| variant_542 | FKKLLLKIPKFLKAALKF | seqid_409 |
| variant_543 | KWKLLLKIPKFLKAALKF | seqid_410 |
| variant_544 | RWKLLLKIPKFLKAALKF | seqid_411 |
| variant_545 | FWKLLLKIPKFLKAALKF | seqid_412 |
| variant_546 | KKKKLLKIPKFLKAALKF | seqid_413 |
| variant_547 | RKKKLLKIPKFLKAALKF | seqid_414 |
| variant_548 | FKKKLLKIPKFLKAALKF | seqid_415 |
| variant_549 | KWKKLLKIPKFLKAALKF | seqid_416 |
| variant_550 | RWKKLLKIPKFLKAALKF | seqid_417 |
| variant_551 | FWKKLLKIPKFLKAALKF | seqid_418 |
| variant_552 | KKKLFKKIPKFLKAALKF | seqid_419 |
| variant_553 | RKKLFKKIPKFLKAALKF | seqid_420 |
| variant_554 | FKKLFKKIPKFLKAALKF | seqid_421 |
| variant_555 | KWKLFKKIPKFLKAALKF | seqid_422 |
| variant_556 | RWKLFKKIPKFLKAALKF | seqid_423 |
| variant_557 | FWKLFKKIPKFLKAALKF | seqid_424 |
| variant_558 | KKKKFKKIPKFLKAALKF | seqid_425 |
| variant_559 | RKKKFKKIPKFLKAALKF | seqid_426 |
| variant_560 | FKKKFKKIPKFLKAALKF | seqid_427 |
| variant_561 | KWKKFKKIPKFLKAALKF | seqid_428 |
| variant_562 | RWKKFKKIPKFLKAALKF | seqid_429 |
| variant_563 | FWKKFKKIPKFLKAALKF | seqid_430 |
| variant_564 | KKKLLKKIPKFLKAALKF | seqid_431 |
| variant_565 | RKKLLKKIPKFLKAALKF | seqid_432 |
| variant_566 | FKKLLKKIPKFLKAALKF | seqid_433 |
| variant_567 | KWKLLKKIPKFLKAALKF | seqid_434 |
| variant_568 | RWKLLKKIPKFLKAALKF | seqid_435 |
| variant_569 | FWKLLKKIPKFLKAALKF | seqid_436 |
| variant_570 | KKKKLKKIPKFLKAALKF | seqid_437 |
| variant_571 | RKKKLKKIPKFLKAALKF | seqid_438 |
| variant_572 | FKKKLKKIPKFLKAALKF | seqid_439 |
| variant_573 | KWKKLKKIPKFLKAALKF | seqid_440 |
| variant_574 | RWKKLKKIPKFLKAALKF | seqid_441 |
| variant_575 | FWKKLKKIPKFLKAALKF | seqid_442 |
| variant_576 | KKKLFLKIPPPKFKKAALKF | seqid_443 |
| variant_577 | RKKLFLKIPPPKFKKAALKF | seqid_444 |
| variant_578 | FKKLFLKIPPPKFKKAALKF | seqid_445 |
| variant_579 | KWKLFLKIPPPKFKKAALKF | seqid_446 |
| variant_580 | RWKLFLKIPPPKFKKAALKF | seqid_447 |
| variant_581 | FWKLFLKIPPPKFKKAALKF | seqid_448 |
| variant_582 | KKKKFLKIPPPKFKKAALKF | seqid_449 |
| variant_583 | RKKKFLKIPPPKFKKAALKF | seqid_450 |
| variant_584 | FKKKFLKIPPPKFKKAALKF | seqid_451 |
| variant_585 | KWKKFLKIPPPKFKKAALKF | seqid_452 |
| variant_586 | RWKKFLKIPPPKFKKAALKF | seqid_453 |
| variant_587 | FWKKFLKIPPPKFKKAALKF | seqid_454 |
| variant_588 | KKKLLLKIPPPKFKKAALKF | seqid_455 |
| variant_589 | RKKLLLKIPPPKFKKAALKF | seqid_456 |
| variant_590 | FKKLLLKIPPPKFKKAALKF | seqid_457 |
| variant_591 | KWKLLLKIPPPKFKKAALKF | seqid_458 |
| variant_592 | RWKLLLKIPPPKFKKAALKF | seqid_459 |
| variant_593 | FWKLLLKIPPPKFKKAALKF | seqid_460 |
| variant_594 | KKKKLLKIPPPKFKKAALKF | seqid_461 |
| variant_595 | RKKKLLKIPPPKFKKAALKF | seqid_462 |
| variant_596 | FKKKLLKIPPPKFKKAALKF | seqid_463 |
| variant_597 | KWKKLLKIPPPKFKKAALKF | seqid_464 |
| variant_598 | RWKKLLKIPPPKFKKAALKF | seqid_465 |
| variant_599 | FWKKLLKIPPPKFKKAALKF | seqid_466 |
| variant_600 | KKKLFKKIPPPKFKKAALKF | seqid_467 |
| variant_601 | RKKLFKKIPPPKFKKAALKF | seqid_468 |
| variant_602 | FKKLFKKIPPPKFKKAALKF | seqid_469 |
| variant_603 | KWKLFKKIPPPKFKKAALKF | seqid_470 |
| variant_604 | RWKLFKKIPPPKFKKAALKF | seqid_471 |
| variant_605 | FWKLFKKIPPPKFKKAALKF | seqid_472 |
| variant_606 | KKKKFKKIPPPKFKKAALKF | seqid_473 |
| variant_607 | RKKKFKKIPPPKFKKAALKF | seqid_474 |
| variant_608 | FKKKFKKIPPPKFKKAALKF | seqid_475 |
| variant_609 | KWKKFKKIPPPKFKKAALKF | seqid_476 |
| variant_610 | RWKKFKKIPPPKFKKAALKF | seqid_477 |
| variant_611 | FWKKFKKIPPPKFKKAALKF | seqid_478 |
| variant_612 | KKKLLKKIPPPKFKKAALKF | seqid_479 |
| variant_613 | RKKLLKKIPPPKFKKAALKF | seqid_480 |

-continued

| variant_614 | FKKLLKKIPPPKFKKAALKF | seqid_481 |
| variant_615 | KWKLLKKIPPPKFKKAALKF | seqid_482 |
| variant_616 | RWKLLKKIPPPKFKKAALKF | seqid_483 |
| variant_617 | FWKLLKKIPPPKFKKAALKF | seqid_484 |
| variant_618 | KKKKLKKIPPPKFKKAALKF | seqid_485 |
| variant_619 | RKKKLKKIPPPKFKKAALKF | seqid_486 |
| variant_620 | FKKKLKKIPPPKFKKAALKF | seqid_487 |
| variant_621 | KWKKLKKIPPPKFKKAALKF | seqid_488 |
| variant_622 | RWKKLKKIPPPKFKKAALKF | seqid_489 |
| variant_623 | FWKKLKKIPPPKFKKAALKF | seqid_490 |
| variant_624 | KKKLFLKIPPKFKKAALKF | seqid_491 |
| variant_625 | RKKLFLKIPPKFKKAALKF | seqid_492 |
| variant_626 | FKKLFLKIPPKFKKAALKF | seqid_493 |
| variant_627 | KWKLFLKIPPKFKKAALKF | seqid_494 |
| variant_628 | RWKLFLKIPPKFKKAALKF | seqid_495 |
| variant_629 | FWKLFLKIPPKFKKAALKF | seqid_496 |
| variant_630 | KKKKFLKIPPKFKKAALKF | seqid_497 |
| variant_631 | RKKKFLKIPPKFKKAALKF | seqid_498 |
| variant_632 | FKKKFLKIPPKFKKAALKF | seqid_499 |
| variant_633 | KWKKFLKIPPKFKKAALKF | seqid_500 |
| variant_634 | RWKKFLKIPPKFKKAALKF | seqid_501 |
| variant_635 | FWKKFLKIPPKFKKAALKF | seqid_502 |
| variant_636 | KKKLLLKIPPKFKKAALKF | seqid_503 |
| variant_637 | RKKLLLKIPPKFKKAALKF | seqid_504 |
| variant_638 | FKKLLLKIPPKFKKAALKF | seqid_505 |
| variant_639 | KWKLLLKIPPKFKKAALKF | seqid_506 |
| variant_640 | RWKLLLKIPPKFKKAALKF | seqid_507 |
| variant_641 | FWKLLLKIPPKFKKAALKF | seqid_508 |
| variant_642 | KKKKLLKIPPKFKKAALKF | seqid_509 |
| variant_643 | RKKKLLKIPPKFKKAALKF | seqid_510 |
| variant_644 | FKKKLLKIPPKFKKAALKF | seqid_511 |
| variant_645 | KWKKLLKIPPKFKKAALKF | seqid_512 |
| variant_646 | RWKKLLKIPPKFKKAALKF | seqid_513 |
| variant_647 | FWKKLLKIPPKFKKAALKF | seqid_514 |
| variant_648 | KKKLFKKIPPKFKKAALKF | seqid_515 |
| variant_649 | RKKLFKKIPPKFKKAALKF | seqid_516 |
| variant_650 | FKKLFKKIPPKFKKAALKF | seqid_517 |
| variant_651 | KWKLFKKIPPKFKKAALKF | seqid_518 |
| variant_652 | RWKLFKKIPPKFKKAALKF | seqid_519 |
| variant_653 | FWKLFKKIPPKFKKAALKF | seqid_520 |

-continued

| variant_654 | KKKKFKKIPPKFKKAALKF | seqid_521 |
| variant_655 | RKKKFKKIPPKFKKAALKF | seqid_522 |
| variant_656 | FKKKFKKIPPKFKKAALKF | seqid_523 |
| variant_657 | KWKKFKKIPPKFKKAALKF | seqid_524 |
| variant_658 | RWKKFKKIPPKFKKAALKF | seqid_525 |
| variant_659 | FWKKFKKIPPKFKKAALKF | seqid_526 |
| variant_660 | KKKLLKKIPPKFKKAALKF | seqid_527 |
| variant_661 | RKKLLKKIPPKFKKAALKF | seqid_528 |
| variant_662 | FKKLLKKIPPKFKKAALKF | seqid_529 |
| variant_663 | KWKLLKKIPPKFKKAALKF | seqid_530 |
| variant_664 | RWKLLKKIPPKFKKAALKF | seqid_531 |
| variant_665 | FWKLLKKIPPKFKKAALKF | seqid_532 |
| variant_666 | KKKKLKKIPPKFKKAALKF | seqid_533 |
| variant_667 | RKKKLKKIPPKFKKAALKF | seqid_534 |
| variant_668 | FKKKLKKIPPKFKKAALKF | seqid_535 |
| variant_669 | KWKKLKKIPPKFKKAALKF | seqid_536 |
| variant_670 | RWKKLKKIPPKFKKAALKF | seqid_537 |
| variant_671 | FWKKLKKIPPKFKKAALKF | seqid_538 |
| variant_720 | KKKLFLKIPKFKKAALKF | seqid_539 |
| variant_721 | RKKLFLKIPKFKKAALKF | seqid_540 |
| variant_722 | FKKLFLKIPKFKKAALKF | seqid_541 |
| variant_723 | KWKLFLKIPKFKKAALKF | seqid_542 |
| variant_724 | RWKLFLKIPKFKKAALKF | seqid_543 |
| variant_725 | FWKLFLKIPKFKKAALKF | seqid_544 |
| variant_726 | KKKKFLKIPKFKKAALKF | seqid_545 |
| variant_727 | RKKKFLKIPKFKKAALKF | seqid_546 |
| variant_728 | FKKKFLKIPKFKKAALKF | seqid_547 |
| variant_729 | KWKKFLKIPKFKKAALKF | seqid_548 |
| variant_730 | RWKKFLKIPKFKKAALKF | seqid_549 |
| variant_731 | FWKKFLKIPKFKKAALKF | seqid_550 |
| variant_732 | KKKLLLKIPKFKKAALKF | seqid_551 |
| variant_733 | RKKLLLKIPKFKKAALKF | seqid_552 |
| variant_734 | FKKLLLKIPKFKKAALKF | seqid_553 |
| variant_735 | KWKLLLKIPKFKKAALKF | seqid_554 |
| variant_736 | RWKLLLKIPKFKKAALKF | seqid_555 |
| variant_737 | FWKLLLKIPKFKKAALKF | seqid_556 |
| variant_738 | KKKKLLKIPKFKKAALKF | seqid_557 |
| variant_739 | RKKKLLKIPKFKKAALKF | seqid_558 |
| variant_740 | FKKKLLKIPKFKKAALKF | seqid_559 |
| variant_741 | KWKKLLKIPKFKKAALKF | seqid_560 |
| variant_742 | RWKKLLKIPKFKKAALKF | seqid_561 |

-continued

| | | |
|---|---|---|
| variant_743 | FWKKLLKIPKFKKAALKF | seqid_562 |
| variant_744 | KKKLFKKIPKFKKAALKF | seqid_563 |
| variant_745 | RKKLFKKIPKFKKAALKF | seqid_564 |
| variant_746 | FKKLFKKIPKFKKAALKF | seqid_565 |
| variant_747 | KWKLFKKIPKFKKAALKF | seqid_566 |
| variant_748 | RWKLFKKIPKFKKAALKF | seqid_567 |
| variant_749 | FWKLFKKIPKFKKAALKF | seqid_568 |
| variant_750 | KKKKFKKIPKFKKAALKF | seqid_569 |
| variant_751 | RKKKFKKIPKFKKAALKF | seqid_570 |
| variant_752 | FKKKFKKIPKFKKAALKF | seqid_571 |
| variant_753 | KWKKFKKIPKFKKAALKF | seqid_572 |
| variant_754 | RWKKFKKIPKFKKAALKF | seqid_573 |
| variant_755 | FWKKFKKIPKFKKAALKF | seqid_574 |
| variant_756 | KKKLLKKIPKFKKAALKF | seqid_575 |
| variant_757 | RKKLLKKIPKFKKAALKF | seqid_576 |
| variant_758 | FKKLLKKIPKFKKAALKF | seqid_577 |
| variant_759 | KWKLLKKIPKFKKAALKF | seqid_578 |
| variant_760 | RWKLLKKIPKFKKAALKF | seqid_579 |
| variant_761 | FWKLLKKIPKFKKAALKF | seqid_580 |
| variant_762 | KKKKLKKIPKFKKAALKF | seqid_581 |
| variant_763 | RKKKLKKIPKFKKAALKF | seqid_582 |
| variant_764 | FKKKLKKIPKFKKAALKF | seqid_583 |
| variant_765 | KWKKLKKIPKFKKAALKF | seqid_584 |
| variant_766 | RWKKLKKIPKFKKAALKF | seqid_585 |
| variant_767 | FWKKLKKIPKFKKAALKF | seqid_586 |
| variant_768 | KKKLFLKIPPPKFLHLALKF | seqid_587 |
| variant_769 | RKKLFLKIPPPKFLHLALKF | seqid_588 |
| variant_770 | FKKLFLKIPPPKFLHLALKF | seqid_589 |
| variant_771 | KWKLFLKIPPPKFLHLALKF | seqid_590 |
| variant_772 | RWKLFLKIPPPKFLHLALKF | seqid_591 |
| variant_773 | FWKLFLKIPPPKFLHLALKF | seqid_592 |
| variant_774 | KKKKFLKIPPPKFLHLALKF | seqid_593 |
| variant_775 | RKKKFLKIPPPKFLHLALKF | seqid_594 |
| variant_776 | FKKKFLKIPPPKFLHLALKF | seqid_595 |
| variant_777 | KWKKFLKIPPPKFLHLALKF | seqid_596 |
| variant_778 | RWKKFLKIPPPKFLHLALKF | seqid_597 |
| variant_779 | FWKKFLKIPPPKFLHLALKF | seqid_598 |
| variant_780 | KKKLLLKIPPPKFLHLALKF | seqid_599 |
| variant_781 | RKKLLLKIPPPKFLHLALKF | seqid_600 |
| variant_782 | FKKLLLKIPPPKFLHLALKF | seqid_601 |
| variant_783 | KWKLLLKIPPPKFLHLALKF | seqid_602 |
| variant_784 | RWKLLLKIPPPKFLHLALKF | seqid_603 |
| variant_785 | FWKLLLKIPPPKFLHLALKF | seqid_604 |
| variant_786 | KKKKLLKIPPPKFLHLALKF | seqid_605 |
| variant_787 | RKKKLLKIPPPKFLHLALKF | seqid_606 |
| variant_788 | FKKKLLKIPPPKFLHLALKF | seqid_607 |
| variant_789 | KWKKLLKIPPPKFLHLALKF | seqid_608 |
| variant_790 | RWKKLLKIPPPKFLHLALKF | seqid_609 |
| variant_791 | FWKKLLKIPPPKFLHLALKF | seqid_610 |
| variant_792 | KKKLFKKIPPPKFLHLALKF | seqid_611 |
| variant_793 | RKKLFKKIPPPKFLHLALKF | seqid_612 |
| variant_794 | FKKLFKKIPPPKFLHLALKF | seqid_613 |
| variant_795 | KWKLFKKIPPPKFLHLALKF | seqid_614 |
| variant_796 | RWKLFKKIPPPKFLHLALKF | seqid_615 |
| variant_797 | FWKLFKKIPPPKFLHLALKF | seqid_616 |
| variant_798 | KKKKFKKIPPPKFLHLALKF | seqid_617 |
| variant_799 | RKKKFKKIPPPKFLHLALKF | seqid_618 |
| variant_800 | FKKKFKKIPPPKFLHLALKF | seqid_619 |
| variant_801 | KWKKFKKIPPPKFLHLALKF | seqid_620 |
| variant_802 | RWKKFKKIPPPKFLHLALKF | seqid_621 |
| variant_803 | FWKKFKKIPPPKFLHLALKF | seqid_622 |
| variant_804 | KKKLLKKIPPPKFLHLALKF | seqid_623 |
| variant_805 | RKKLLKKIPPPKFLHLALKF | seqid_624 |
| variant_806 | FKKLLKKIPPPKFLHLALKF | seqid_625 |
| variant_807 | KWKLLKKIPPPKFLHLALKF | seqid_626 |
| variant_808 | RWKLLKKIPPPKFLHLALKF | seqid_627 |
| variant_809 | FWKLLKKIPPPKFLHLALKF | seqid_628 |
| variant_810 | KKKKLKKIPPPKFLHLALKF | seqid_629 |
| variant_811 | RKKKLKKIPPPKFLHLALKF | seqid_630 |
| variant_812 | FKKKLKKIPPPKFLHLALKF | seqid_631 |
| variant_813 | KWKKLKKIPPPKFLHLALKF | seqid_632 |
| variant_814 | RWKKLKKIPPPKFLHLALKF | seqid_633 |
| variant_815 | FWKKLKKIPPPKFLHLALKF | seqid_634 |
| variant_816 | KKKLFLKIPPKFLHLALKF | seqid_635 |
| variant_817 | RKKLFLKIPPKFLHLALKF | seqid_636 |
| variant_818 | FKKLFLKIPPKFLHLALKF | seqid_637 |
| variant_819 | KWKLFLKIPPKFLHLALKF | seqid_638 |
| variant_820 | RWKLFLKIPPKFLHLALKF | seqid_639 |
| variant_821 | FWKLFLKIPPKFLHLALKF | seqid_640 |
| variant_822 | KKKKFLKIPPKFLHLALKF | seqid_641 |
| variant_823 | RKKKFLKIPPKFLHLALKF | seqid_642 |

| | | |
|---|---|---|
| variant_824 | FKKKFLKIPPKFLHLALKF | seqid_643 |
| variant_825 | KWKKFLKIPPKFLHLALKF | seqid_644 |
| variant_826 | RWKKFLKIPPKFLHLALKF | seqid_645 |
| variant_827 | FWKKFLKIPPKFLHLALKF | seqid_646 |
| variant_828 | KKKLLLKIPPKFLHLALKF | seqid_647 |
| variant_829 | RKKLLLKIPPKFLHLALKF | seqid_648 |
| variant_830 | FKKLLLKIPPKFLHLALKF | seqid_649 |
| variant_831 | KWKLLLKIPPKFLHLALKF | seqid_650 |
| variant_832 | RWKLLLKIPPKFLHLALKF | seqid_651 |
| variant_833 | FWKLLLKIPPKFLHLALKF | seqid_652 |
| variant_834 | KKKKLLKIPPKFLHLALKF | seqid_653 |
| variant_835 | RKKKLLKIPPKFLHLALKF | seqid_654 |
| variant_836 | FKKKLLKIPPKFLHLALKF | seqid_655 |
| variant_837 | KWKKLLKIPPKFLHLALKF | seqid_656 |
| variant_838 | RWKKLLKIPPKFLHLALKF | seqid_657 |
| variant_839 | FWKKLLKIPPKFLHLALKF | seqid_658 |
| variant_840 | KKKLFKKIPPKFLHLALKF | seqid_659 |
| variant_841 | RKKLFKKIPPKFLHLALKF | seqid_660 |
| variant_842 | FKKLFKKIPPKFLHLALKF | seqid_661 |
| variant_843 | KWKLFKKIPPKFLHLALKF | seqid_662 |
| variant_844 | RWKLFKKIPPKFLHLALKF | seqid_663 |
| variant_845 | FWKLFKKIPPKFLHLALKF | seqid_664 |
| variant_846 | KKKKFKKIPPKFLHLALKF | seqid_665 |
| variant_847 | RKKKFKKIPPKFLHLALKF | seqid_666 |
| variant_848 | FKKKFKKIPPKFLHLALKF | seqid_667 |
| variant_849 | KWKKFKKIPPKFLHLALKF | seqid_668 |
| variant_850 | RWKKFKKIPPKFLHLALKF | seqid_669 |
| variant_851 | FWKKFKKIPPKFLHLALKF | seqid_670 |
| variant_852 | KKKLLKKIPPKFLHLALKF | seqid_671 |
| variant_853 | RKKLLKKIPPKFLHLALKF | seqid_672 |
| variant_854 | FKKLLKKIPPKFLHLALKF | seqid_673 |
| variant_855 | KWKLLKKIPPKFLHLALKF | seqid_674 |
| variant_856 | RWKLLKKIPPKFLHLALKF | seqid_675 |
| variant_857 | FWKLLKKIPPKFLHLALKF | seqid_676 |
| variant_858 | KKKKLKKIPPKFLHLALKF | seqid_677 |
| variant_859 | RKKKLKKIPPKFLHLALKF | seqid_678 |
| variant_860 | FKKKLKKIPPKFLHLALKF | seqid_679 |
| variant_861 | KWKKLKKIPPKFLHLALKF | seqid_680 |
| variant_862 | RWKKLKKIPPKFLHLALKF | seqid_681 |
| variant_863 | FWKKLKKIPPKFLHLALKF | seqid_682 |
| variant_912 | KKKLFLKIPKFLHLALKF | seqid_683 |
| variant_913 | RKKLFLKIPKFLHLALKF | seqid_684 |
| variant_914 | FKKLFLKIPKFLHLALKF | seqid_685 |
| variant_915 | KWKLFLKIPKFLHLALKF | seqid_686 |
| variant_916 | RWKLFLKIPKFLHLALKF | seqid_687 |
| variant_917 | FWKLFLKIPKFLHLALKF | seqid_688 |
| variant_918 | KKKKFLKIPKFLHLALKF | seqid_689 |
| variant_919 | RKKKFLKIPKFLHLALKF | seqid_690 |
| variant_920 | FKKKFLKIPKFLHLALKF | seqid_691 |
| variant_921 | KWKKFLKIPKFLHLALKF | seqid_692 |
| variant_922 | RWKKFLKIPKFLHLALKF | seqid_693 |
| variant_923 | FWKKFLKIPKFLHLALKF | seqid_694 |
| variant_924 | KKKLLLKIPKFLHLALKF | seqid_695 |
| variant_925 | RKKLLLKIPKFLHLALKF | seqid_696 |
| variant_926 | FKKLLLKIPKFLHLALKF | seqid_697 |
| variant_927 | KWKLLLKIPKFLHLALKF | seqid_698 |
| variant_928 | RWKLLLKIPKFLHLALKF | seqid_699 |
| variant_929 | FWKLLLKIPKFLHLALKF | seqid_700 |
| variant_930 | KKKKLLKIPKFLHLALKF | seqid_701 |
| variant_931 | RKKKLLKIPKFLHLALKF | seqid_702 |
| variant_932 | FKKKLLKIPKFLHLALKF | seqid_703 |
| variant_933 | KWKKLLKIPKFLHLALKF | seqid_704 |
| variant_934 | RWKKLLKIPKFLHLALKF | seqid_705 |
| variant_935 | FWKKLLKIPKFLHLALKF | seqid_706 |
| variant_936 | KKKLFKKIPKFLHLALKF | seqid_707 |
| variant_937 | RKKLFKKIPKFLHLALKF | seqid_708 |
| variant_938 | FKKLFKKIPKFLHLALKF | seqid_709 |
| variant_939 | KWKLFKKIPKFLHLALKF | seqid_710 |
| variant_940 | RWKLFKKIPKFLHLALKF | seqid_711 |
| variant_941 | FWKLFKKIPKFLHLALKF | seqid_712 |
| variant_942 | KKKKFKKIPKFLHLALKF | seqid_713 |
| variant_943 | RKKKFKKIPKFLHLALKF | seqid_714 |
| variant_944 | FKKKFKKIPKFLHLALKF | seqid_715 |
| variant_945 | KWKKFKKIPKFLHLALKF | seqid_716 |
| variant_946 | RWKKFKKIPKFLHLALKF | seqid_717 |
| variant_947 | FWKKFKKIPKFLHLALKF | seqid_718 |
| variant_948 | KKKLLKKIPKFLHLALKF | seqid_719 |
| variant_949 | RKKLLKKIPKFLHLALKF | seqid_720 |
| variant_950 | FKKLLKKIPKFLHLALKF | seqid_721 |
| variant_951 | KWKLLKKIPKFLHLALKF | seqid_722 |
| variant_952 | RWKLLKKIPKFLHLALKF | seqid_723 |

| | | |
|---|---|---|
| variant_953 | FWKLLKKIPKFLHLALKF | seqid_724 |
| variant_954 | KKKKLKKIPKFLHLALKF | seqid_725 |
| variant_955 | RKKKLKKIPKFLHLALKF | seqid_726 |
| variant_956 | FKKKLKKIPKFLHLALKF | seqid_727 |
| variant_957 | KWKKLKKIPKFLHLALKF | seqid_728 |
| variant_958 | RWKKLKKIPKFLHLALKF | seqid_729 |
| variant_959 | FWKKLKKIPKFLHLALKF | seqid_730 |
| variant_960 | KKKLFLKIPPPKFKHLALKF | seqid_731 |
| variant_961 | RKKLFLKIPPPKFKHLALKF | seqid_732 |
| variant_962 | FKKLFLKIPPPKFKHLALKF | seqid_733 |
| variant_963 | KWKLFLKIPPPKFKHLALKF | seqid_734 |
| variant_964 | RWKLFLKIPPPKFKHLALKF | seqid_735 |
| variant_965 | FWKLFLKIPPPKFKHLALKF | seqid_736 |
| variant_966 | KKKKFLKIPPPKFKHLALKF | seqid_737 |
| variant_967 | RKKKFLKIPPPKFKHLALKF | seqid_738 |
| variant_968 | FKKKFLKIPPPKFKHLALKF | seqid_739 |
| variant_969 | KWKKFLKIPPPKFKHLALKF | seqid_740 |
| variant_970 | RWKKFLKIPPPKFKHLALKF | seqid_741 |
| variant_971 | FWKKFLKIPPPKFKHLALKF | seqid_742 |
| variant_972 | KKKLLLKIPPPKFKHLALKF | seqid_743 |
| variant_973 | RKKLLLKIPPPKFKHLALKF | seqid_744 |
| variant_974 | FKKLLLKIPPPKFKHLALKF | seqid_745 |
| variant_975 | KWKLLLKIPPPKFKHLALKF | seqid_746 |
| variant_976 | RWKLLLKIPPPKFKHLALKF | seqid_747 |
| variant_977 | FWKLLLKIPPPKFKHLALKF | seqid_748 |
| variant_978 | KKKKLLKIPPPKFKHLALKF | seqid_749 |
| variant_979 | RKKKLLKIPPPKFKHLALKF | seqid_750 |
| variant_980 | FKKKLLKIPPPKFKHLALKF | seqid_751 |
| variant_981 | KWKKLLKIPPPKFKHLALKF | seqid_752 |
| variant_982 | RWKKLLKIPPPKFKHLALKF | seqid_753 |
| variant_983 | FWKKLLKIPPPKFKHLALKF | seqid_754 |
| variant_984 | KKKLFKKIPPPKFKHLALKF | seqid_755 |
| variant_985 | RKKLFKKIPPPKFKHLALKF | seqid_756 |
| variant_986 | FKKLFKKIPPPKFKHLALKF | seqid_757 |
| variant_987 | KWKLFKKIPPPKFKHLALKF | seqid_758 |
| variant_988 | RWKLFKKIPPPKFKHLALKF | seqid_759 |
| variant_989 | FWKLFKKIPPPKFKHLALKF | seqid_760 |
| variant_990 | KKKKFKKIPPPKFKHLALKF | seqid_761 |
| variant_991 | RKKKFKKIPPPKFKHLALKF | seqid_762 |
| variant_992 | FKKKFKKIPPPKFKHLALKF | seqid_763 |
| variant_993 | KWKKFKKIPPPKFKHLALKF | seqid_764 |
| variant_994 | RWKKFKKIPPPKFKHLALKF | seqid_765 |
| variant_995 | FWKKFKKIPPPKFKHLALKF | seqid_766 |
| variant_996 | KKKLLKKIPPPKFKHLALKF | seqid_767 |
| variant_997 | RKKLLKKIPPPKFKHLALKF | seqid_768 |
| variant_998 | FKKLLKKIPPPKFKHLALKF | seqid_769 |
| variant_999 | KWKLLKKIPPPKFKHLALKF | seqid_770 |
| variant_1000 | RWKLLKKIPPPKFKHLALKF | seqid_771 |
| variant_1001 | FWKLLKKIPPPKFKHLALKF | seqid_772 |
| variant_1002 | KKKKLKKIPPPKFKHLALKF | seqid_773 |
| variant_1003 | RKKKLKKIPPPKFKHLALKF | seqid_774 |
| variant_1004 | FKKKLKKIPPPKFKHLALKF | seqid_775 |
| variant_1005 | KWKKLKKIPPPKFKHLALKF | seqid_776 |
| variant_1006 | RWKKLKKIPPPKFKHLALKF | seqid_777 |
| variant_1007 | FWKKLKKIPPPKFKHLALKF | seqid_778 |
| variant_1008 | KKKLFLKIPPKFKHLALKF | seqid_779 |
| variant_1009 | RKKLFLKIPPKFKHLALKF | seqid_780 |
| variant_1010 | FKKLFLKIPPKFKHLALKF | seqid_781 |
| variant_1011 | KWKLFLKIPPKFKHLALKF | seqid_782 |
| variant_1012 | RWKLFLKIPPKFKHLALKF | seqid_783 |
| variant_1013 | FWKLFLKIPPKFKHLALKF | seqid_784 |
| variant_1014 | KKKKFLKIPPKFKHLALKF | seqid_785 |
| variant_1015 | RKKKFLKIPPKFKHLALKF | seqid_786 |
| variant_1016 | FKKKFLKIPPKFKHLALKF | seqid_787 |
| variant_1017 | KWKKFLKIPPKFKHLALKF | seqid_788 |
| variant_1018 | RWKKFLKIPPKFKHLALKF | seqid_789 |
| variant_1019 | FWKKFLKIPPKFKHLALKF | seqid_790 |
| variant_1020 | KKKLLLKIPPKFKHLALKF | seqid_791 |
| variant_1021 | RKKLLLKIPPKFKHLALKF | seqid_792 |
| variant_1022 | FKKLLLKIPPKFKHLALKF | seqid_793 |
| variant_1023 | KWKLLLKIPPKFKHLALKF | seqid_794 |
| variant_1024 | RWKLLLKIPPKFKHLALKF | seqid_795 |
| variant_1025 | FWKLLLKIPPKFKHLALKF | seqid_796 |
| variant_1026 | KKKKLLKIPPKFKHLALKF | seqid_797 |
| variant_1027 | RKKKLLKIPPKFKHLALKF | seqid_798 |
| variant_1028 | FKKKLLKIPPKFKHLALKF | seqid_799 |
| variant_1029 | KWKKLLKIPPKFKHLALKF | seqid_800 |
| variant_1030 | RWKKLLKIPPKFKHLALKF | seqid_801 |
| variant_1031 | FWKKLLKIPPKFKHLALKF | seqid_802 |
| variant_1032 | KKKLFKKIPPKFKHLALKF | seqid_803 |
| variant_1033 | RKKLFKKIPPKFKHLALKF | seqid_804 |

-continued

| | | |
|---|---|---|
| variant_1034 | FKKLFKKIPPKFKHLALKF | seqid_805 |
| variant_1035 | KWKLFKKIPPKFKHLALKF | seqid_806 |
| variant_1036 | RWKLFKKIPPKFKHLALKF | seqid_807 |
| variant_1037 | FWKLFKKIPPKFKHLALKF | seqid_808 |
| variant_1038 | KKKKFKKIPPKFKHLALKF | seqid_809 |
| variant_1039 | RKKKFKKIPPKFKHLALKF | seqid_810 |
| variant_1040 | FKKKFKKIPPKFKHLALKF | seqid_811 |
| variant_1041 | KWKKFKKIPPKFKHLALKF | seqid_812 |
| variant_1042 | RWKKFKKIPPKFKHLALKF | seqid_813 |
| variant_1043 | FWKKFKKIPPKFKHLALKF | seqid_814 |
| variant_1044 | KKKLLKKIPPKFKHLALKF | seqid_815 |
| variant_1045 | RKKLLKKIPPKFKHLALKF | seqid_816 |
| variant_1046 | FKKLLKKIPPKFKHLALKF | seqid_817 |
| variant_1047 | KWKLLKKIPPKFKHLALKF | seqid_818 |
| variant_1048 | RWKLLKKIPPKFKHLALKF | seqid_819 |
| variant_1049 | FWKLLKKIPPKFKHLALKF | seqid_820 |
| variant_1050 | KKKKLKKIPPKFKHLALKF | seqid_821 |
| variant_1051 | RKKKLKKIPPKFKHLALKF | seqid_822 |
| variant_1052 | FKKKLKKIPPKFKHLALKF | seqid_823 |
| variant_1053 | KWKKLKKIPPKFKHLALKF | seqid_824 |
| variant_1054 | RWKKLKKIPPKFKHLALKF | seqid_825 |
| variant_1055 | FWKKLKKIPPKFKHLALKF | seqid_826 |
| variant_1104 | KKKLFLKIPKFKHLALKF | seqid_827 |
| variant_1105 | RKKLFLKIPKFKHLALKF | seqid_828 |
| variant_1106 | FKKLFLKIPKFKHLALKF | seqid_829 |
| variant_1107 | KWKLFLKIPKFKHLALKF | seqid_830 |
| variant_1108 | RWKLFLKIPKFKHLALKF | seqid_831 |
| variant_1109 | FWKLFLKIPKFKHLALKF | seqid_832 |
| variant_1110 | KKKKFLKIPKFKHLALKF | seqid_833 |
| variant_1111 | RKKKFLKIPKFKHLALKF | seqid_834 |
| variant_1112 | FKKKFLKIPKFKHLALKF | seqid_835 |
| variant_1113 | KWKKFLKIPKFKHLALKF | seqid_836 |
| variant_1114 | RWKKFLKIPKFKHLALKF | seqid_837 |
| variant_1115 | FWKKFLKIPKFKHLALKF | seqid_838 |
| variant_1116 | KKKLLLKIPKFKHLALKF | seqid_839 |
| variant_1117 | RKKLLLKIPKFKHLALKF | seqid_840 |
| variant_1118 | FKKLLLKIPKFKHLALKF | seqid_841 |
| variant_1119 | KWKLLLKIPKFKHLALKF | seqid_842 |
| variant_1120 | RWKLLLKIPKFKHLALKF | seqid_843 |
| variant_1121 | FWKLLLKIPKFKHLALKF | seqid_844 |
| variant_1122 | KKKKLLKIPKFKHLALKF | seqid_845 |
| variant_1123 | RKKKLLKIPKFKHLALKF | seqid_846 |
| variant_1124 | FKKKLLKIPKFKHLALKF | seqid_847 |
| variant_1125 | KWKKLLKIPKFKHLALKF | seqid_848 |
| variant_1126 | RWKKLLKIPKFKHLALKF | seqid_849 |
| variant_1127 | FWKKLLKIPKFKHLALKF | seqid_850 |
| variant_1128 | KKKLFKKIPKFKHLALKF | seqid_851 |
| variant_1129 | RKKLFKKIPKFKHLALKF | seqid_852 |
| variant_1130 | FKKLFKKIPKFKHLALKF | seqid_853 |
| variant_1131 | KWKLFKKIPKFKHLALKF | seqid_854 |
| variant_1132 | RWKLFKKIPKFKHLALKF | seqid_855 |
| variant_1133 | FWKLFKKIPKFKHLALKF | seqid_856 |
| variant_1134 | KKKKFKKIPKFKHLALKF | seqid_857 |
| variant_1135 | RKKKFKKIPKFKHLALKF | seqid_858 |
| variant_1136 | FKKKFKKIPKFKHLALKF | seqid_859 |
| variant_1137 | KWKKFKKIPKFKHLALKF | seqid_860 |
| variant_1138 | RWKKFKKIPKFKHLALKF | seqid_861 |
| variant_1139 | FWKKFKKIPKFKHLALKF | seqid_862 |
| variant_1140 | KKKLLKKIPKFKHLALKF | seqid_863 |
| variant_1141 | RKKLLKKIPKFKHLALKF | seqid_864 |
| variant_1142 | FKKLLKKIPKFKHLALKF | seqid_865 |
| variant_1143 | KWKLLKKIPKFKHLALKF | seqid_866 |
| variant_1144 | RWKLLKKIPKFKHLALKF | seqid_867 |
| variant_1145 | FWKLLKKIPKFKHLALKF | seqid_868 |
| variant_1146 | KKKKLKKIPKFKHLALKF | seqid_869 |
| variant_1147 | RKKKLKKIPKFKHLALKF | seqid_870 |
| variant_1148 | FKKKLKKIPKFKHLALKF | seqid_871 |
| variant_1149 | KWKKLKKIPKFKHLALKF | seqid_872 |
| variant_1150 | RWKKLKKIPKFKHLALKF | seqid_873 |
| variant_1151 | FWKKLKKIPKFKHLALKF | seqid_874 |
| variant_1152 | KKKLFLKIPPPKFLKLALKF | seqid_875 |
| variant_1153 | RKKLFLKIPPPKFLKLALKF | seqid_876 |
| variant_1154 | FKKLFLKIPPPKFLKLALKF | seqid_877 |
| variant_1155 | KWKLFLKIPPPKFLKLALKF | seqid_878 |
| variant_1156 | RWKLFLKIPPPKFLKLALKF | seqid_879 |
| variant_1157 | FWKLFLKIPPPKFLKLALKF | seqid_880 |
| variant_1158 | KKKKFLKIPPPKFLKLALKF | seqid_881 |
| variant_1159 | RKKKFLKIPPPKFLKLALKF | seqid_882 |
| variant_1160 | FKKKFLKIPPPKFLKLALKF | seqid_883 |
| variant_1161 | KWKKFLKIPPPKFLKLALKF | seqid_884 |
| variant_1162 | RWKKFLKIPPPKFLKLALKF | seqid_885 |

-continued

| | | |
|---|---|---|
| variant_1163 | FWKKFLKIPPPKFLKLALKF | seqid_886 |
| variant_1164 | KKKLLLKIPPPKFLKLALKF | seqid_887 |
| variant_1165 | RKKLLLKIPPPKFLKLALKF | seqid_888 |
| variant_1166 | FKKLLLKIPPPKFLKLALKF | seqid_889 |
| variant_1167 | KWKLLLKIPPPKFLKLALKF | seqid_890 |
| variant_1168 | RWKLLLKIPPPKFLKLALKF | seqid_891 |
| variant_1169 | FWKLLLKIPPPKFLKLALKF | seqid_892 |
| variant_1170 | KKKKLLKIPPPKFLKLALKF | seqid_893 |
| variant_1171 | RKKKLLKIPPPKFLKLALKF | seqid_894 |
| variant_1172 | FKKKLLKIPPPKFLKLALKF | seqid_895 |
| variant_1173 | KWKKLLKIPPPKFLKLALKF | seqid_896 |
| variant_1174 | RWKKLLKIPPPKFLKLALKF | seqid_897 |
| variant_1175 | FWKKLLKIPPPKFLKLALKF | seqid_898 |
| variant_1176 | KKKLFKKIPPPKFLKLALKF | seqid_899 |
| variant_1177 | RKKLFKKIPPPKFLKLALKF | seqid_900 |
| variant_1178 | FKKLFKKIPPPKFLKLALKF | seqid_901 |
| variant_1179 | KWKLFKKIPPPKFLKLALKF | seqid_902 |
| variant_1180 | RWKLFKKIPPPKFLKLALKF | seqid_903 |
| variant_1181 | FWKLFKKIPPPKFLKLALKF | seqid_904 |
| variant_1182 | KKKKFKKIPPPKFLKLALKF | seqid_905 |
| variant_1183 | RKKKFKKIPPPKFLKLALKF | seqid_906 |
| variant_1184 | FKKKFKKIPPPKFLKLALKF | seqid_907 |
| variant_1185 | KWKKFKKIPPPKFLKLALKF | seqid_908 |
| variant_1186 | RWKKFKKIPPPKFLKLALKF | seqid_909 |
| variant_1187 | FWKKFKKIPPPKFLKLALKF | seqid_910 |
| variant_1188 | KKKLLKKIPPPKFLKLALKF | seqid_911 |
| variant_1189 | RKKLLKKIPPPKFLKLALKF | seqid_912 |
| variant_1190 | FKKLLKKIPPPKFLKLALKF | seqid_913 |
| variant_1191 | KWKLLKKIPPPKFLKLALKF | seqid_914 |
| variant_1192 | RWKLLKKIPPPKFLKLALKF | seqid_915 |
| variant_1193 | FWKLLKKIPPPKFLKLALKF | seqid_916 |
| variant_1194 | KKKKLKKIPPPKFLKLALKF | seqid_917 |
| variant_1195 | RKKKLKKIPPPKFLKLALKF | seqid_918 |
| variant_1196 | FKKKLKKIPPPKFLKLALKF | seqid_919 |
| variant_1197 | KWKKLKKIPPPKFLKLALKF | seqid_920 |
| variant_1198 | RWKKLKKIPPPKFLKLALKF | seqid_921 |
| variant_1199 | FWKKLKKIPPPKFLKLALKF | seqid_922 |
| variant_1200 | KKKLFLKIPPPKFLKLALKF | seqid_923 |
| variant_1201 | RKKLFLKIPPPKFLKLALKF | seqid_924 |
| variant_1202 | FKKLFLKIPPPKFLKLALKF | seqid_925 |
| variant_1203 | KWKLFLKIPPPKFLKLALKF | seqid_926 |
| variant_1204 | RWKLFLKIPPPKFLKLALKF | seqid_927 |
| variant_1205 | FWKLFLKIPPPKFLKLALKF | seqid_928 |
| variant_1206 | KKKKFLKIPPPKFLKLALKF | seqid_929 |
| variant_1207 | RKKKFLKIPPPKFLKLALKF | seqid_930 |
| variant_1208 | FKKKFLKIPPPKFLKLALKF | seqid_931 |
| variant_1209 | KWKKFLKIPPPKFLKLALKF | seqid_932 |
| variant_1210 | RWKKFLKIPPPKFLKLALKF | seqid_933 |
| variant_1211 | FWKKFLKIPPPKFLKLALKF | seqid_934 |
| variant_1212 | KKKLLLKIPPPKFLKLALKF | seqid_935 |
| variant_1213 | RKKLLLKIPPPKFLKLALKF | seqid_936 |
| variant_1214 | FKKLLLKIPPPKFLKLALKF | seqid_937 |
| variant_1215 | KWKLLLKIPPPKFLKLALKF | seqid_938 |
| variant_1216 | RWKLLLKIPPPKFLKLALKF | seqid_939 |
| variant_1217 | FWKLLLKIPPPKFLKLALKF | seqid_940 |
| variant_1218 | KKKKLLKIPPPKFLKLALKF | seqid_941 |
| variant_1219 | RKKKLLKIPPPKFLKLALKF | seqid_942 |
| variant_1220 | FKKKLLKIPPPKFLKLALKF | seqid_943 |
| variant_1221 | KWKKLLKIPPPKFLKLALKF | seqid_944 |
| variant_1222 | RWKKLLKIPPPKFLKLALKF | seqid_945 |
| variant_1223 | FWKKLLKIPPPKFLKLALKF | seqid_946 |
| variant_1224 | KKKLFKKIPPPKFLKLALKF | seqid_947 |
| variant_1225 | RKKLFKKIPPPKFLKLALKF | seqid_948 |
| variant_1226 | FKKLFKKIPPPKFLKLALKF | seqid_949 |
| variant_1227 | KWKLFKKIPPPKFLKLALKF | seqid_950 |
| variant_1228 | RWKLFKKIPPPKFLKLALKF | seqid_951 |
| variant_1229 | FWKLFKKIPPPKFLKLALKF | seqid_952 |
| variant_1230 | KKKKFKKIPPPKFLKLALKF | seqid_953 |
| variant_1231 | RKKKFKKIPPPKFLKLALKF | seqid_954 |
| variant_1232 | FKKKFKKIPPPKFLKLALKF | seqid_955 |
| variant_1233 | KWKKFKKIPPPKFLKLALKF | seqid_956 |
| variant_1234 | RWKKFKKIPPPKFLKLALKF | seqid_957 |
| variant_1235 | FWKKFKKIPPPKFLKLALKF | seqid_958 |
| variant_1236 | KKKLLKKIPPPKFLKLALKF | seqid_959 |
| variant_1237 | RKKLLKKIPPPKFLKLALKF | seqid_960 |
| variant_1238 | FKKLLKKIPPPKFLKLALKF | seqid_961 |
| variant_1239 | KWKLLKKIPPPKFLKLALKF | seqid_962 |
| variant_1240 | RWKLLKKIPPPKFLKLALKF | seqid_963 |
| variant_1241 | FWKLLKKIPPPKFLKLALKF | seqid_964 |
| variant_1242 | KKKKLKKIPPPKFLKLALKF | seqid_965 |
| variant_1243 | RKKKLKKIPPPKFLKLALKF | seqid_966 |

-continued

| | | |
|---|---|---|
| variant_1244 | FKKKLKKIPPKFLKLALKF | seqid_967 |
| variant_1245 | KWKKLKKIPPKFLKLALKF | seqid_968 |
| variant_1246 | RWKKLKKIPPKFLKLALKF | seqid_969 |
| variant_1247 | FWKKLKKIPPKFLKLALKF | seqid_970 |
| variant_1296 | KKKLFLKIPKFLKLALKF | seqid_971 |
| variant_1297 | RKKLFLKIPKFLKLALKF | seqid_972 |
| variant_1298 | FKKLFLKIPKFLKLALKF | seqid_973 |
| variant_1299 | KWKLFLKIPKFLKLALKF | seqid_974 |
| variant_1300 | RWKLFLKIPKFLKLALKF | seqid_975 |
| variant_1301 | FWKLFLKIPKFLKLALKF | seqid_976 |
| variant_1302 | KKKKFLKIPKFLKLALKF | seqid_977 |
| variant_1303 | RKKKFLKIPKFLKLALKF | seqid_978 |
| variant_1304 | FKKKFLKIPKFLKLALKF | seqid_979 |
| variant_1305 | KWKKFLKIPKFLKLALKF | seqid_980 |
| variant_1306 | RWKKFLKIPKFLKLALKF | seqid_981 |
| variant_1307 | FWKKFLKIPKFLKLALKF | seqid_982 |
| variant_1308 | KKKLLLKIPKFLKLALKF | seqid_983 |
| variant_1309 | RKKLLLKIPKFLKLALKF | seqid_984 |
| variant_1310 | FKKLLLKIPKFLKLALKF | seqid_985 |
| variant_1311 | KWKLLLKIPKFLKLALKF | seqid_986 |
| variant_1312 | RWKLLLKIPKFLKLALKF | seqid_987 |
| variant_1313 | FWKLLLKIPKFLKLALKF | seqid_988 |
| variant_1314 | KKKKLLKIPKFLKLALKF | seqid_989 |
| variant_1315 | RKKKLLKIPKFLKLALKF | seqid_990 |
| variant_1316 | FKKKLLKIPKFLKLALKF | seqid_991 |
| variant_1317 | KWKKLLKIPKFLKLALKF | seqid_992 |
| variant_1318 | RWKKLLKIPKFLKLALKF | seqid_993 |
| variant_1319 | FWKKLLKIPKFLKLALKF | seqid_994 |
| variant_1320 | KKKLFKKIPKFLKLALKF | seqid_995 |
| variant_1321 | RKKLFKKIPKFLKLALKF | seqid_996 |
| variant_1322 | FKKLFKKIPKFLKLALKF | seqid_997 |
| variant_1323 | KWKLFKKIPKFLKLALKF | seqid_998 |
| variant_1324 | RWKLFKKIPKFLKLALKF | seqid_999 |
| variant_1325 | FWKLFKKIPKFLKLALKF | seqid_1000 |
| variant_1326 | KKKKFKKIPKFLKLALKF | seqid_1001 |
| variant_1327 | RKKKFKKIPKFLKLALKF | seqid_1002 |
| variant_1328 | FKKKFKKIPKFLKLALKF | seqid_1003 |
| variant_1329 | KWKKFKKIPKFLKLALKF | seqid_1004 |
| variant_1330 | RWKKFKKIPKFLKLALKF | seqid_1005 |
| variant_1331 | FWKKFKKIPKFLKLALKF | seqid_1006 |
| variant_1332 | KKKLLKKIPKFLKLALKF | seqid_1007 |
| variant_1333 | RKKLLKKIPKFLKLALKF | seqid_1008 |
| variant_1334 | FKKLLKKIPKFLKLALKF | seqid_1009 |
| variant_1335 | KWKLLKKIPKFLKLALKF | seqid_1010 |
| variant_1336 | RWKLLKKIPKFLKLALKF | seqid_1011 |
| variant_1337 | FWKLLKKIPKFLKLALKF | seqid_1012 |
| variant_1338 | KKKKLKKIPKFLKLALKF | seqid_1013 |
| variant_1339 | RKKKLKKIPKFLKLALKF | seqid_1014 |
| variant_1340 | FKKKLKKIPKFLKLALKF | seqid_1015 |
| variant_1341 | KWKKLKKIPKFLKLALKF | seqid_1016 |
| variant_1342 | RWKKLKKIPKFLKLALKF | seqid_1017 |
| variant_1343 | FWKKLKKIPKFLKLALKF | seqid_1018 |
| variant_1344 | KKKLFLKIPPPKFKKLALKF | seqid_1019 |
| variant_1345 | RKKLFLKIPPPKFKKLALKF | seqid_1020 |
| variant_1346 | FKKLFLKIPPPKFKKLALKF | seqid_1021 |
| variant_1347 | KWKLFLKIPPPKFKKLALKF | seqid_1022 |
| variant_1348 | RWKLFLKIPPPKFKKLALKF | seqid_1023 |
| variant_1349 | FWKLFLKIPPPKFKKLALKF | seqid_1024 |
| variant_1350 | KKKKFLKIPPPKFKKLALKF | seqid_1025 |
| variant_1351 | RKKKFLKIPPPKFKKLALKF | seqid_1026 |
| variant_1352 | FKKKFLKIPPPKFKKLALKF | seqid_1027 |
| variant_1353 | KWKKFLKIPPPKFKKLALKF | seqid_1028 |
| variant_1354 | RWKKFLKIPPPKFKKLALKF | seqid_1029 |
| variant_1355 | FWKKFLKIPPPKFKKLALKF | seqid_1030 |
| variant_1356 | KKKLLLKIPPPKFKKLALKF | seqid_1031 |
| variant_1357 | RKKLLLKIPPPKFKKLALKF | seqid_1032 |
| variant_1358 | FKKLLLKIPPPKFKKLALKF | seqid_1033 |
| variant_1359 | KWKLLLKIPPPKFKKLALKF | seqid_1034 |
| variant_1360 | RWKLLLKIPPPKFKKLALKF | seqid_1035 |
| variant_1361 | FWKLLLKIPPPKFKKLALKF | seqid_1036 |
| variant_1362 | KKKKLLKIPPPKFKKLALKF | seqid_1037 |
| variant_1363 | RKKKLLKIPPPKFKKLALKF | seqid_1038 |
| variant_1364 | FKKKLLKIPPPKFKKLALKF | seqid_1039 |
| variant_1365 | KWKKLLKIPPPKFKKLALKF | seqid_1040 |
| variant_1366 | RWKKLLKIPPPKFKKLALKF | seqid_1041 |
| variant_1367 | FWKKLLKIPPPKFKKLALKF | seqid_1042 |
| variant_1368 | KKKLFKKIPPPKFKKLALKF | seqid_1043 |
| variant_1369 | RKKLFKKIPPPKFKKLALKF | seqid_1044 |
| variant_1370 | FKKLFKKIPPPKFKKLALKF | seqid_1045 |
| variant_1371 | KWKLFKKIPPPKFKKLALKF | seqid_1046 |
| variant_1372 | RWKLFKKIPPPKFKKLALKF | seqid_1047 |

| | | |
|---|---|---|
| variant_1373 | FWKLFKKIPPPKFKKLALKF | seqid_1048 |
| variant_1374 | KKKKFKKIPPPKFKKLALKF | seqid_1049 |
| variant_1375 | RKKKFKKIPPPKFKKLALKF | seqid_1050 |
| variant_1376 | FKKKFKKIPPPKFKKLALKF | seqid_1051 |
| variant_1377 | KWKKFKKIPPPKFKKLALKF | seqid_1052 |
| variant_1378 | RWKKFKKIPPPKFKKLALKF | seqid_1053 |
| variant_1379 | FWKKFKKIPPPKFKKLALKF | seqid_1054 |
| variant_1380 | KKKLLKKIPPPKFKKLALKF | seqid_1055 |
| variant_1381 | RKKLLKKIPPPKFKKLALKF | seqid_1056 |
| variant_1382 | FKKLLKKIPPPKFKKLALKF | seqid_1057 |
| variant_1383 | KWKLLKKIPPPKFKKLALKF | seqid_1058 |
| variant_1384 | RWKLLKKIPPPKFKKLALKF | seqid_1059 |
| variant_1385 | FWKLLKKIPPPKFKKLALKF | seqid_1060 |
| variant_1386 | KKKKLKKIPPPKFKKLALKF | seqid_1061 |
| variant_1387 | RKKKLKKIPPPKFKKLALKF | seqid_1062 |
| variant_1388 | FKKKLKKIPPPKFKKLALKF | seqid_1063 |
| variant_1389 | KWKKLKKIPPPKFKKLALKF | seqid_1064 |
| variant_1390 | RWKKLKKIPPPKFKKLALKF | seqid_1065 |
| variant_1391 | FWKKLKKIPPPKFKKLALKF | seqid_1066 |
| variant_1392 | KKKLFLKIPPKFKKLALKF | seqid_1067 |
| variant_1393 | RKKLFLKIPPKFKKLALKF | seqid_1068 |
| variant_1394 | FKKLFLKIPPKFKKLALKF | seqid_1069 |
| variant_1395 | KWKLFLKIPPKFKKLALKF | seqid_1070 |
| variant_1396 | RWKLFLKIPPKFKKLALKF | seqid_1071 |
| variant_1397 | FWKLFLKIPPKFKKLALKF | seqid_1072 |
| variant_1398 | KKKKFLKIPPKFKKLALKF | seqid_1073 |
| variant_1399 | RKKKFLKIPPKFKKLALKF | seqid_1074 |
| variant_1400 | FKKKFLKIPPKFKKLALKF | seqid_1075 |
| variant_1401 | KWKKFLKIPPKFKKLALKF | seqid_1076 |
| variant_1402 | RWKKFLKIPPKFKKLALKF | seqid_1077 |
| variant_1403 | FWKKFLKIPPKFKKLALKF | seqid_1078 |
| variant_1404 | KKKLLLKIPPKFKKLALKF | seqid_1079 |
| variant_1405 | RKKLLLKIPPKFKKLALKF | seqid_1080 |
| variant_1406 | FKKLLLKIPPKFKKLALKF | seqid_1081 |
| variant_1407 | KWKLLLKIPPKFKKLALKF | seqid_1082 |
| variant_1408 | RWKLLLKIPPKFKKLALKF | seqid_1083 |
| variant_1409 | FWKLLLKIPPKFKKLALKF | seqid_1084 |
| variant_1410 | KKKKLLKIPPKFKKLALKF | seqid_1085 |
| variant_1411 | RKKKLLKIPPKFKKLALKF | seqid_1086 |
| variant_1412 | FKKKLLKIPPKFKKLALKF | seqid_1087 |
| variant_1413 | KWKKLLKIPPKFKKLALKF | seqid_1088 |
| variant_1414 | RWKKLLKIPPKFKKLALKF | seqid_1089 |
| variant_1415 | FWKKLLKIPPKFKKLALKF | seqid_1090 |
| variant_1416 | KKKLFKKIPPKFKKLALKF | seqid_1091 |
| variant_1417 | RKKLFKKIPPKFKKLALKF | seqid_1092 |
| variant_1418 | FKKLFKKIPPKFKKLALKF | seqid_1093 |
| variant_1419 | KWKLFKKIPPKFKKLALKF | seqid_1094 |
| variant_1420 | RWKLFKKIPPKFKKLALKF | seqid_1095 |
| variant_1421 | FWKLFKKIPPKFKKLALKF | seqid_1096 |
| variant_1422 | KKKKFKKIPPKFKKLALKF | seqid_1097 |
| variant_1423 | RKKKFKKIPPKFKKLALKF | seqid_1098 |
| variant_1424 | FKKKFKKIPPKFKKLALKF | seqid_1099 |
| variant_1425 | KWKKFKKIPPKFKKLALKF | seqid_1100 |
| variant_1426 | RWKKFKKIPPKFKKLALKF | seqid_1101 |
| variant_1427 | FWKKFKKIPPKFKKLALKF | seqid_1102 |
| variant_1428 | KKKLLKKIPPKFKKLALKF | seqid_1103 |
| variant_1429 | RKKLLKKIPPKFKKLALKF | seqid_1104 |
| variant_1430 | FKKLLKKIPPKFKKLALKF | seqid_1105 |
| variant_1431 | KWKLLKKIPPKFKKLALKF | seqid_1106 |
| variant_1432 | RWKLLKKIPPKFKKLALKF | seqid_1107 |
| variant_1433 | FWKLLKKIPPKFKKLALKF | seqid_1108 |
| variant_1434 | KKKKLKKIPPKFKKLALKF | seqid_1109 |
| variant_1435 | RKKKLKKIPPKFKKLALKF | seqid_1110 |
| variant_1436 | FKKKLKKIPPKFKKLALKF | seqid_1111 |
| variant_1437 | KWKKLKKIPPKFKKLALKF | seqid_1112 |
| variant_1438 | RWKKLKKIPPKFKKLALKF | seqid_1113 |
| variant_1439 | FWKKLKKIPPKFKKLALKF | seqid_1114 |
| variant_1488 | KKKLFLKIPKFKKLALKF | seqid_1115 |
| variant_1489 | RKKLFLKIPKFKKLALKF | seqid_1116 |
| variant_1490 | FKKLFLKIPKFKKLALKF | seqid_1117 |
| variant_1491 | KWKLFLKIPKFKKLALKF | seqid_1118 |
| variant_1492 | RWKLFLKIPKFKKLALKF | seqid_1119 |
| variant_1493 | FWKLFLKIPKFKKLALKF | seqid_1120 |
| variant_1494 | KKKKFLKIPKFKKLALKF | seqid_1121 |
| variant_1495 | RKKKFLKIPKFKKLALKF | seqid_1122 |
| variant_1496 | FKKKFLKIPKFKKLALKF | seqid_1123 |
| variant_1497 | KWKKFLKIPKFKKLALKF | seqid_1124 |
| variant_1498 | RWKKFLKIPKFKKLALKF | seqid_1125 |
| variant_1499 | FWKKFLKIPKFKKLALKF | seqid_1126 |
| variant_1500 | KKKLLLKIPKFKKLALKF | seqid_1127 |
| variant_1501 | RKKLLLKIPKFKKLALKF | seqid_1128 |

-continued

| | | |
|---|---|---|
| variant_1502 | FKKLLLKIPKFKKLALKF | seqid_1129 |
| variant_1503 | KWKLLLKIPKFKKLALKF | seqid_1130 |
| variant_1504 | RWKLLLKIPKFKKLALKF | seqid_1131 |
| variant_1505 | FWKLLLKIPKFKKLALKF | seqid_1132 |
| variant_1506 | KKKKLLKIPKFKKLALKF | seqid_1133 |
| variant_1507 | RKKKLLKIPKFKKLALKF | seqid_1134 |
| variant_1508 | FKKKLLKIPKFKKLALKF | seqid_1135 |
| variant_1509 | KWKKLLKIPKFKKLALKF | seqid_1136 |
| variant_1510 | RWKKLLKIPKFKKLALKF | seqid_1137 |
| variant_1511 | FWKKLLKIPKFKKLALKF | seqid_1138 |
| variant_1512 | KKKLFKKIPKFKKLALKF | seqid_1139 |
| variant_1513 | RKKLFKKIPKFKKLALKF | seqid_1140 |
| variant_1514 | FKKLFKKIPKFKKLALKF | seqid_1141 |
| variant_1515 | KWKLFKKIPKFKKLALKF | seqid_1142 |
| variant_1516 | RWKLFKKIPKFKKLALKF | seqid_1143 |
| variant_1517 | FWKLFKKIPKFKKLALKF | seqid_1144 |
| variant_1518 | KKKKFKKIPKFKKLALKF | seqid_1145 |
| variant_1519 | RKKKFKKIPKFKKLALKF | seqid_1146 |
| variant_1520 | FKKKFKKIPKFKKLALKF | seqid_1147 |
| variant_1521 | KWKKFKKIPKFKKLALKF | seqid_1148 |
| variant_1522 | RWKKFKKIPKFKKLALKF | seqid_1149 |
| variant_1523 | FWKKFKKIPKFKKLALKF | seqid_1150 |
| variant_1524 | KKKLLKKIPKFKKLALKF | seqid_1151 |
| variant_1525 | RKKLLKKIPKFKKLALKF | seqid_1152 |
| variant_1526 | FKKLLKKIPKFKKLALKF | seqid_1153 |
| variant_1527 | KWKLLKKIPKFKKLALKF | seqid_6 |
| variant_1528 | RWKLLKKIPKFKKLALKF | seqid_1154 |
| variant_1529 | FWKLLKKIPKFKKLALKF | seqid_1155 |
| variant_1530 | KKKKLKKIPKFKKLALKF | seqid_1156 |
| variant_1531 | RKKKLKKIPKFKKLALKF | seqid_1157 |
| variant_1532 | FKKKLKKIPKFKKLALKF | seqid_1158 |
| variant_1533 | KWKKLKKIPKFKKLALKF | seqid_1159 |
| variant_1534 | RWKKLKKIPKFKKLALKF | seqid_1160 |
| variant_1535 | FWKKLKKIPKFKKLALKF | seqid_1161 |
| variant_1536 | KKKLFLKIPPPKFLHVALKF | seqid_1162 |
| variant_1537 | RKKLFLKIPPPKFLHVALKF | seqid_1163 |
| variant_1538 | FKKLFLKIPPPKFLHVALKF | seqid_1164 |
| variant_1539 | KWKLFLKIPPPKFLHVALKF | seqid_1165 |
| variant_1540 | RWKLFLKIPPPKFLHVALKF | seqid_1166 |
| variant_1541 | FWKLFLKIPPPKFLHVALKF | seqid_1167 |
| variant_1542 | KKKKFLKIPPPKFLHVALKF | seqid_1168 |
| variant_1543 | RKKKFLKIPPPKFLHVALKF | seqid_1169 |
| variant_1544 | FKKKFLKIPPPKFLHVALKF | seqid_1170 |
| variant_1545 | KWKKFLKIPPPKFLHVALKF | seqid_1171 |
| variant_1546 | RWKKFLKIPPPKFLHVALKF | seqid_1172 |
| variant_1547 | FWKKFLKIPPPKFLHVALKF | seqid_1173 |
| variant_1548 | KKKLLLKIPPPKFLHVALKF | seqid_1174 |
| variant_1549 | RKKLLLKIPPPKFLHVALKF | seqid_1175 |
| variant_1550 | FKKLLLKIPPPKFLHVALKF | seqid_1176 |
| variant_1551 | KWKLLLKIPPPKFLHVALKF | seqid_1177 |
| variant_1552 | RWKLLLKIPPPKFLHVALKF | seqid_1178 |
| variant_1553 | FWKLLLKIPPPKFLHVALKF | seqid_1179 |
| variant_1554 | KKKKLLKIPPPKFLHVALKF | seqid_1180 |
| variant_1555 | RKKKLLKIPPPKFLHVALKF | seqid_1181 |
| variant_1556 | FKKKLLKIPPPKFLHVALKF | seqid_1182 |
| variant_1557 | KWKKLLKIPPPKFLHVALKF | seqid_1183 |
| variant_1558 | RWKKLLKIPPPKFLHVALKF | seqid_1184 |
| variant_1559 | FWKKLLKIPPPKFLHVALKF | seqid_1185 |
| variant_1560 | KKKLFKKIPPPKFLHVALKF | seqid_1186 |
| variant_1561 | RKKLFKKIPPPKFLHVALKF | seqid_1187 |
| variant_1562 | FKKLFKKIPPPKFLHVALKF | seqid_1188 |
| variant_1563 | KWKLFKKIPPPKFLHVALKF | seqid_1189 |
| variant_1564 | RWKLFKKIPPPKFLHVALKF | seqid_1190 |
| variant_1565 | FWKLFKKIPPPKFLHVALKF | seqid_1191 |
| variant_1566 | KKKKFKKIPPPKFLHVALKF | seqid_1192 |
| variant_1567 | RKKKFKKIPPPKFLHVALKF | seqid_1193 |
| variant_1568 | FKKKFKKIPPPKFLHVALKF | seqid_1194 |
| variant_1569 | KWKKFKKIPPPKFLHVALKF | seqid_1195 |
| variant_1570 | RWKKFKKIPPPKFLHVALKF | seqid_1196 |
| variant_1571 | FWKKFKKIPPPKFLHVALKF | seqid_1197 |
| variant_1572 | KKKLLKKIPPPKFLHVALKF | seqid_1198 |
| variant_1573 | RKKLLKKIPPPKFLHVALKF | seqid_1199 |
| variant_1574 | FKKLLKKIPPPKFLHVALKF | seqid_1200 |
| variant_1575 | KWKLLKKIPPPKFLHVALKF | seqid_1201 |
| variant_1576 | RWKLLKKIPPPKFLHVALKF | seqid_1202 |
| variant_1577 | FWKLLKKIPPPKFLHVALKF | seqid_1203 |
| variant_1578 | KKKKLKKIPPPKFLHVALKF | seqid_1204 |
| variant_1579 | RKKKLKKIPPPKFLHVALKF | seqid_1205 |
| variant_1580 | FKKKLKKIPPPKFLHVALKF | seqid_1206 |
| variant_1581 | KWKKLKKIPPPKFLHVALKF | seqid_1207 |
| variant_1582 | RWKKLKKIPPPKFLHVALKF | seqid_1208 |

| | | |
|---|---|---|
| variant_1583 | FWKKLKKIPPPKFLHVALKF | seqid_1209 |
| variant_1584 | KKKLFLKIPPKFLHVALKF | seqid_1210 |
| variant_1585 | RKKLFLKIPPKFLHVALKF | seqid_1211 |
| variant_1586 | FKKLFLKIPPKFLHVALKF | seqid_1212 |
| variant_1587 | KWKLFLKIPPKFLHVALKF | seqid_1213 |
| variant_1588 | RWKLFLKIPPKFLHVALKF | seqid_1214 |
| variant_1589 | FWKLFLKIPPKFLHVALKF | seqid_1215 |
| variant_1590 | KKKKFLKIPPKFLHVALKF | seqid_1216 |
| variant_1591 | RKKKFLKIPPKFLHVALKF | seqid_1217 |
| variant_1592 | FKKKFLKIPPKFLHVALKF | seqid_1218 |
| variant_1593 | KWKKFLKIPPKFLHVALKF | seqid_1219 |
| variant_1594 | RWKKFLKIPPKFLHVALKF | seqid_1220 |
| variant_1595 | FWKKFLKIPPKFLHVALKF | seqid_1221 |
| variant_1596 | KKKLLLKIPPKFLHVALKF | seqid_1222 |
| variant_1597 | RKKLLLKIPPKFLHVALKF | seqid_1223 |
| variant_1598 | FKKLLLKIPPKFLHVALKF | seqid_1224 |
| variant_1599 | KWKLLLKIPPKFLHVALKF | seqid_1225 |
| variant_1600 | RWKLLLKIPPKFLHVALKF | seqid_1226 |
| variant_1601 | FWKLLLKIPPKFLHVALKF | seqid_1227 |
| variant_1602 | KKKKLLKIPPKFLHVALKF | seqid_1228 |
| variant_1603 | RKKKLLKIPPKFLHVALKF | seqid_1229 |
| variant_1604 | FKKKLLKIPPKFLHVALKF | seqid_1230 |
| variant_1605 | KWKKLLKIPPKFLHVALKF | seqid_1231 |
| variant_1606 | RWKKLLKIPPKFLHVALKF | seqid_1232 |
| variant_1607 | FWKKLLKIPPKFLHVALKF | seqid_1233 |
| variant_1608 | KKKLFKKIPPKFLHVALKF | seqid_1234 |
| variant_1609 | RKKLFKKIPPKFLHVALKF | seqid_1235 |
| variant_1610 | FKKLFKKIPPKFLHVALKF | seqid_1236 |
| variant_1611 | KWKLFKKIPPKFLHVALKF | seqid_1237 |
| variant_1612 | RWKLFKKIPPKFLHVALKF | seqid_1238 |
| variant_1613 | FWKLFKKIPPKFLHVALKF | seqid_1239 |
| variant_1614 | KKKKFKKIPPKFLHVALKF | seqid_1240 |
| variant_1615 | RKKKFKKIPPKFLHVALKF | seqid_1241 |
| variant_1616 | FKKKFKKIPPKFLHVALKF | seqid_1242 |
| variant_1617 | KWKKFKKIPPKFLHVALKF | seqid_1243 |
| variant_1618 | RWKKFKKIPPKFLHVALKF | seqid_1244 |
| variant_1619 | FWKKFKKIPPKFLHVALKF | seqid_1245 |
| variant_1620 | KKKLLKKIPPKFLHVALKF | seqid_1246 |
| variant_1621 | RKKLLKKIPPKFLHVALKF | seqid_1247 |
| variant_1622 | FKKLLKKIPPKFLHVALKF | seqid_1248 |
| variant_1623 | KWKLLKKIPPKFLHVALKF | seqid_1249 |
| variant_1624 | RWKLLKKIPPKFLHVALKF | seqid_1250 |
| variant_1625 | FWKLLKKIPPKFLHVALKF | seqid_1251 |
| variant_1626 | KKKKLKKIPPKFLHVALKF | seqid_1252 |
| variant_1627 | RKKKLKKIPPKFLHVALKF | seqid_1253 |
| variant_1628 | FKKKLKKIPPKFLHVALKF | seqid_1254 |
| variant_1629 | KWKKLKKIPPKFLHVALKF | seqid_1255 |
| variant_1630 | RWKKLKKIPPKFLHVALKF | seqid_1256 |
| variant_1631 | FWKKLKKIPPKFLHVALKF | seqid_1257 |
| variant_1680 | KKKLFLKIPKFLHVALKF | seqid_1258 |
| variant_1681 | RKKLFLKIPKFLHVALKF | seqid_1259 |
| variant_1682 | FKKLFLKIPKFLHVALKF | seqid_1260 |
| variant_1683 | KWKLFLKIPKFLHVALKF | seqid_1261 |
| variant_1684 | RWKLFLKIPKFLHVALKF | seqid_1262 |
| variant_1685 | FWKLFLKIPKFLHVALKF | seqid_1263 |
| variant_1686 | KKKKFLKIPKFLHVALKF | seqid_1264 |
| variant_1687 | RKKKFLKIPKFLHVALKF | seqid_1265 |
| variant_1688 | FKKKFLKIPKFLHVALKF | seqid_1266 |
| variant_1689 | KWKKFLKIPKFLHVALKF | seqid_1267 |
| variant_1690 | RWKKFLKIPKFLHVALKF | seqid_1268 |
| variant_1691 | FWKKFLKIPKFLHVALKF | seqid_1269 |
| variant_1692 | KKKLLLKIPKFLHVALKF | seqid_1270 |
| variant_1693 | RKKLLLKIPKFLHVALKF | seqid_1271 |
| variant_1694 | FKKLLLKIPKFLHVALKF | seqid_1272 |
| variant_1695 | KWKLLLKIPKFLHVALKF | seqid_1273 |
| variant_1696 | RWKLLLKIPKFLHVALKF | seqid_1274 |
| variant_1697 | FWKLLLKIPKFLHVALKF | seqid_1275 |
| variant_1698 | KKKKLLKIPKFLHVALKF | seqid_1276 |
| variant_1699 | RKKKLLKIPKFLHVALKF | seqid_1277 |
| variant_1700 | FKKKLLKIPKFLHVALKF | seqid_1278 |
| variant_1701 | KWKKLLKIPKFLHVALKF | seqid_1279 |
| variant_1702 | RWKKLLKIPKFLHVALKF | seqid_1280 |
| variant_1703 | FWKKLLKIPKFLHVALKF | seqid_1281 |
| variant_1704 | KKKLFKKIPKFLHVALKF | seqid_1282 |
| variant_1705 | RKKLFKKIPKFLHVALKF | seqid_1283 |
| variant_1706 | FKKLFKKIPKFLHVALKF | seqid_1284 |
| variant_1707 | KWKLFKKIPKFLHVALKF | seqid_1285 |
| variant_1708 | RWKLFKKIPKFLHVALKF | seqid_1286 |
| variant_1709 | FWKLFKKIPKFLHVALKF | seqid_1287 |
| variant_1710 | KKKKFKKIPKFLHVALKF | seqid_1288 |
| variant_1711 | RKKKFKKIPKFLHVALKF | seqid_1289 |

| variant | sequence | seqid |
|---|---|---|
| variant_1712 | FKKKFKKIPKFLHVALKF | seqid_1290 |
| variant_1713 | KWKKFKKIPKFLHVALKF | seqid_1291 |
| variant_1714 | RWKKFKKIPKFLHVALKF | seqid_1292 |
| variant_1715 | FWKKFKKIPKFLHVALKF | seqid_1293 |
| variant_1716 | KKKLLKKIPKFLHVALKF | seqid_1294 |
| variant_1717 | RKKLLKKIPKFLHVALKF | seqid_1295 |
| variant_1718 | FKKLLKKIPKFLHVALKF | seqid_1296 |
| variant_1719 | KWKLLKKIPKFLHVALKF | seqid_1297 |
| variant_1720 | RWKLLKKIPKFLHVALKF | seqid_1298 |
| variant_1721 | FWKLLKKIPKFLHVALKF | seqid_1299 |
| variant_1722 | KKKKLKKIPKFLHVALKF | seqid_1300 |
| variant_1723 | RKKKLKKIPKFLHVALKF | seqid_1301 |
| variant_1724 | FKKKLKKIPKFLHVALKF | seqid_1302 |
| variant_1725 | KWKKLKKIPKFLHVALKF | seqid_1303 |
| variant_1726 | RWKKLKKIPKFLHVALKF | seqid_1304 |
| variant_1727 | FWKKLKKIPKFLHVALKF | seqid_1305 |
| variant_1728 | KKKLFLKIPPPKFKHVALKF | seqid_1306 |
| variant_1729 | RKKLFLKIPPPKFKHVALKF | seqid_1307 |
| variant_1730 | FKKLFLKIPPPKFKHVALKF | seqid_1308 |
| variant_1731 | KWKLFLKIPPPKFKHVALKF | seqid_1309 |
| variant_1732 | RWKLFLKIPPPKFKHVALKF | seqid_1310 |
| variant_1733 | FWKLFLKIPPPKFKHVALKF | seqid_1311 |
| variant_1734 | KKKKFLKIPPPKFKHVALKF | seqid_1312 |
| variant_1735 | RKKKFLKIPPPKFKHVALKF | seqid_1313 |
| variant_1736 | FKKKFLKIPPPKFKHVALKF | seqid_1314 |
| variant_1737 | KWKKFLKIPPPKFKHVALKF | seqid_1315 |
| variant_1738 | RWKKFLKIPPPKFKHVALKF | seqid_1316 |
| variant_1739 | FWKKFLKIPPPKFKHVALKF | seqid_1317 |
| variant_1740 | KKKLLLKIPPPKFKHVALKF | seqid_1318 |
| variant_1741 | RKKLLLKIPPPKFKHVALKF | seqid_1319 |
| variant_1742 | FKKLLLKIPPPKFKHVALKF | seqid_1320 |
| variant_1743 | KWKLLLKIPPPKFKHVALKF | seqid_1321 |
| variant_1744 | RWKLLLKIPPPKFKHVALKF | seqid_1322 |
| variant_1745 | FWKLLLKIPPPKFKHVALKF | seqid_1323 |
| variant_1746 | KKKKLLKIPPPKFKHVALKF | seqid_1324 |
| variant_1747 | RKKKLLKIPPPKFKHVALKF | seqid_1325 |
| variant_1748 | FKKKLLKIPPPKFKHVALKF | seqid_1326 |
| variant_1749 | KWKKLLKIPPPKFKHVALKF | seqid_1327 |
| variant_1750 | RWKKLLKIPPPKFKHVALKF | seqid_1328 |
| variant_1751 | FWKKLLKIPPPKFKHVALKF | seqid_1329 |
| variant_1752 | KKKLFKKIPPPKFKHVALKF | seqid_1330 |
| variant_1753 | RKKLFKKIPPPKFKHVALKF | seqid_1331 |
| variant_1754 | FKKLFKKIPPPKFKHVALKF | seqid_1332 |
| variant_1755 | KWKLFKKIPPPKFKHVALKF | seqid_1333 |
| variant_1756 | RWKLFKKIPPPKFKHVALKF | seqid_1334 |
| variant_1757 | FWKLFKKIPPPKFKHVALKF | seqid_1335 |
| variant_1758 | KKKKFKKIPPPKFKHVALKF | seqid_1336 |
| variant_1759 | RKKKFKKIPPPKFKHVALKF | seqid_1337 |
| variant_1760 | FKKKFKKIPPPKFKHVALKF | seqid_1338 |
| variant_1761 | KWKKFKKIPPPKFKHVALKF | seqid_1339 |
| variant_1762 | RWKKFKKIPPPKFKHVALKF | seqid_1340 |
| variant_1763 | FWKKFKKIPPPKFKHVALKF | seqid_1341 |
| variant_1764 | KKKLLKKIPPPKFKHVALKF | seqid_1342 |
| variant_1765 | RKKLLKKIPPPKFKHVALKF | seqid_1343 |
| variant_1766 | FKKLLKKIPPPKFKHVALKF | seqid_1344 |
| variant_1767 | KWKLLKKIPPPKFKHVALKF | seqid_1345 |
| variant_1768 | RWKLLKKIPPPKFKHVALKF | seqid_1346 |
| variant_1769 | FWKLLKKIPPPKFKHVALKF | seqid_1347 |
| variant_1770 | KKKKLKKIPPPKFKHVALKF | seqid_1348 |
| variant_1771 | RKKKLKKIPPPKFKHVALKF | seqid_1349 |
| variant_1772 | FKKKLKKIPPPKFKHVALKF | seqid_1350 |
| variant_1773 | KWKKLKKIPPPKFKHVALKF | seqid_1351 |
| variant_1774 | RWKKLKKIPPPKFKHVALKF | seqid_1352 |
| variant_1775 | FWKKLKKIPPPKFKHVALKF | seqid_1353 |
| variant_1776 | KKKLFLKIPPKFKHVALKF | seqid_1354 |
| variant_1777 | RKKLFLKIPPKFKHVALKF | seqid_1355 |
| variant_1778 | FKKLFLKIPPKFKHVALKF | seqid_1356 |
| variant_1779 | KWKLFLKIPPKFKHVALKF | seqid_1357 |
| variant_1780 | RWKLFLKIPPKFKHVALKF | seqid_1358 |
| variant_1781 | FWKLFLKIPPKFKHVALKF | seqid_1359 |
| variant_1782 | KKKKFLKIPPKFKHVALKF | seqid_1360 |
| variant_1783 | RKKKFLKIPPKFKHVALKF | seqid_1361 |
| variant_1784 | FKKKFLKIPPKFKHVALKF | seqid_1362 |
| variant_1785 | KWKKFLKIPPKFKHVALKF | seqid_1363 |
| variant_1786 | RWKKFLKIPPKFKHVALKF | seqid_1364 |
| variant_1787 | FWKKFLKIPPKFKHVALKF | seqid_1365 |
| variant_1788 | KKKLLLKIPPKFKHVALKF | seqid_1366 |
| variant_1789 | RKKLLLKIPPKFKHVALKF | seqid_1367 |
| variant_1790 | FKKLLLKIPPKFKHVALKF | seqid_1368 |
| variant_1791 | KWKLLLKIPPKFKHVALKF | seqid_1369 |
| variant_1792 | RWKLLLKIPPKFKHVALKF | seqid_1370 |

-continued

| | | |
|---|---|---|
| variant_1793 | FWKLLLKIPPKFKHVALKF | seqid_1371 |
| variant_1794 | KKKKLLKIPPKFKHVALKF | seqid_1372 |
| variant_1795 | RKKKLLKIPPKFKHVALKF | seqid_1373 |
| variant_1796 | FKKKLLKIPPKFKHVALKF | seqid_1374 |
| variant_1797 | KWKKLLKIPPKFKHVALKF | seqid_1375 |
| variant_1798 | RWKKLLKIPPKFKHVALKF | seqid_1376 |
| variant_1799 | FWKKLLKIPPKFKHVALKF | seqid_1377 |
| variant_1800 | KKKLFKKIPPKFKHVALKF | seqid_1378 |
| variant_1801 | RKKLFKKIPPKFKHVALKF | seqid_1379 |
| variant_1802 | FKKLFKKIPPKFKHVALKF | seqid_1380 |
| variant_1803 | KWKLFKKIPPKFKHVALKF | seqid_1381 |
| variant_1804 | RWKLFKKIPPKFKHVALKF | seqid_1382 |
| variant_1805 | FWKLFKKIPPKFKHVALKF | seqid_1383 |
| variant_1806 | KKKKFKKIPPKFKHVALKF | seqid_1384 |
| variant_1807 | RKKKFKKIPPKFKHVALKF | seqid_1385 |
| variant_1808 | FKKKFKKIPPKFKHVALKF | seqid_1386 |
| variant_1809 | KWKKFKKIPPKFKHVALKF | seqid_1387 |
| variant_1810 | RWKKFKKIPPKFKHVALKF | seqid_1388 |
| variant_1811 | FWKKFKKIPPKFKHVALKF | seqid_1389 |
| variant_1812 | KKKLLKKIPPKFKHVALKF | seqid_1390 |
| variant_1813 | RKKLLKKIPPKFKHVALKF | seqid_1391 |
| variant_1814 | FKKLLKKIPPKFKHVALKF | seqid_1392 |
| variant_1815 | KWKLLKKIPPKFKHVALKF | seqid_1393 |
| variant_1816 | RWKLLKKIPPKFKHVALKF | seqid_1394 |
| variant_1817 | FWKLLKKIPPKFKHVALKF | seqid_1395 |
| variant_1818 | KKKKLKKIPPKFKHVALKF | seqid_1396 |
| variant_1819 | RKKKLKKIPPKFKHVALKF | seqid_1397 |
| variant_1820 | FKKKLKKIPPKFKHVALKF | seqid_1398 |
| variant_1821 | KWKKLKKIPPKFKHVALKF | seqid_1399 |
| variant_1822 | RWKKLKKIPPKFKHVALKF | seqid_1400 |
| variant_1823 | FWKKLKKIPPKFKHVALKF | seqid_1401 |
| variant_1872 | KKKLFLKIPKFKHVALKF | seqid_1402 |
| variant_1873 | RKKLFLKIPKFKHVALKF | seqid_1403 |
| variant_1874 | FKKLFLKIPKFKHVALKF | seqid_1404 |
| variant_1875 | KWKLFLKIPKFKHVALKF | seqid_1405 |
| variant_1876 | RWKLFLKIPKFKHVALKF | seqid_1406 |
| variant_1877 | FWKLFLKIPKFKHVALKF | seqid_1407 |
| variant_1878 | KKKKFLKIPKFKHVALKF | seqid_1408 |
| variant_1879 | RKKKFLKIPKFKHVALKF | seqid_1409 |
| variant_1880 | FKKKFLKIPKFKHVALKF | seqid_1410 |
| variant_1881 | KWKKFLKIPKFKHVALKF | seqid_1411 |
| variant_1882 | RWKKFLKIPKFKHVALKF | seqid_1412 |
| variant_1883 | FWKKFLKIPKFKHVALKF | seqid_1413 |
| variant_1884 | KKKLLLKIPKFKHVALKF | seqid_1414 |
| variant_1885 | RKKLLLKIPKFKHVALKF | seqid_1415 |
| variant_1886 | FKKLLLKIPKFKHVALKF | seqid_1416 |
| variant_1887 | KWKLLLKIPKFKHVALKF | seqid_1417 |
| variant_1888 | RWKLLLKIPKFKHVALKF | seqid_1418 |
| variant_1889 | FWKLLLKIPKFKHVALKF | seqid_1419 |
| variant_1890 | KKKKLLKIPKFKHVALKF | seqid_1420 |
| variant_1891 | RKKKLLKIPKFKHVALKF | seqid_1421 |
| variant_1892 | FKKKLLKIPKFKHVALKF | seqid_1422 |
| variant_1893 | KWKKLLKIPKFKHVALKF | seqid_1423 |
| variant_1894 | RWKKLLKIPKFKHVALKF | seqid_1424 |
| variant_1895 | FWKKLLKIPKFKHVALKF | seqid_1425 |
| variant_1896 | KKKLFKKIPKFKHVALKF | seqid_1426 |
| variant_1897 | RKKLFKKIPKFKHVALKF | seqid_1427 |
| variant_1898 | FKKLFKKIPKFKHVALKF | seqid_1428 |
| variant_1899 | KWKLFKKIPKFKHVALKF | seqid_1429 |
| variant_1900 | RWKLFKKIPKFKHVALKF | seqid_1430 |
| variant_1901 | FWKLFKKIPKFKHVALKF | seqid_1431 |
| variant_1902 | KKKKFKKIPKFKHVALKF | seqid_1432 |
| variant_1903 | RKKKFKKIPKFKHVALKF | seqid_1433 |
| variant_1904 | FKKKFKKIPKFKHVALKF | seqid_1434 |
| variant_1905 | KWKKFKKIPKFKHVALKF | seqid_1435 |
| variant_1906 | RWKKFKKIPKFKHVALKF | seqid_1436 |
| variant_1907 | FWKKFKKIPKFKHVALKF | seqid_1437 |
| variant_1908 | KKKLLKKIPKFKHVALKF | seqid_1438 |
| variant_1909 | RKKLLKKIPKFKHVALKF | seqid_1439 |
| variant_1910 | FKKLLKKIPKFKHVALKF | seqid_1440 |
| variant_1911 | KWKLLKKIPKFKHVALKF | seqid_1441 |
| variant_1912 | RWKLLKKIPKFKHVALKF | seqid_1442 |
| variant_1913 | FWKLLKKIPKFKHVALKF | seqid_1443 |
| variant_1914 | KKKKLKKIPKFKHVALKF | seqid_1444 |
| variant_1915 | RKKKLKKIPKFKHVALKF | seqid_1445 |
| variant_1916 | FKKKLKKIPKFKHVALKF | seqid_1446 |
| variant_1917 | KWKKLKKIPKFKHVALKF | seqid_1447 |
| variant_1918 | RWKKLKKIPKFKHVALKF | seqid_1448 |
| variant_1919 | FWKKLKKIPKFKHVALKF | seqid_1449 |
| variant_1920 | KKKLFLKIPPPKFLKVALKF | seqid_1450 |
| variant_1921 | RKKLFLKIPPPKFLKVALKF | seqid_1451 |

| variant_1922 | FKKLFLKIPPPKFLKVALKF | seqid_1452 |
| variant_1923 | KWKLFLKIPPPKFLKVALKF | seqid_1453 |
| variant_1924 | RWKLFLKIPPPKFLKVALKF | seqid_1454 |
| variant_1925 | FWKLFLKIPPPKFLKVALKF | seqid_1455 |
| variant_1926 | KKKKFLKIPPPKFLKVALKF | seqid_1456 |
| variant_1927 | RKKKFLKIPPPKFLKVALKF | seqid_1457 |
| variant_1928 | FKKKFLKIPPPKFLKVALKF | seqid_1458 |
| variant_1929 | KWKKFLKIPPPKFLKVALKF | seqid_1459 |
| variant_1930 | RWKKFLKIPPPKFLKVALKF | seqid_1460 |
| variant_1931 | FWKKFLKIPPPKFLKVALKF | seqid_1461 |
| variant_1932 | KKKLLLKIPPPKFLKVALKF | seqid_1462 |
| variant_1933 | RKKLLLKIPPPKFLKVALKF | seqid_1463 |
| variant_1934 | FKKLLLKIPPPKFLKVALKF | seqid_1464 |
| variant_1935 | KWKLLLKIPPPKFLKVALKF | seqid_1465 |
| variant_1936 | RWKLLLKIPPPKFLKVALKF | seqid_1466 |
| variant_1937 | FWKLLLKIPPPKFLKVALKF | seqid_1467 |
| variant_1938 | KKKKLLKIPPPKFLKVALKF | seqid_1468 |
| variant_1939 | RKKKLLKIPPPKFLKVALKF | seqid_1469 |
| variant_1940 | FKKKLLKIPPPKFLKVALKF | seqid_1470 |
| variant_1941 | KWKKLLKIPPPKFLKVALKF | seqid_1471 |
| variant_1942 | RWKKLLKIPPPKFLKVALKF | seqid_1472 |
| variant_1943 | FWKKLLKIPPPKFLKVALKF | seqid_1473 |
| variant_1944 | KKKLFKKIPPPKFLKVALKF | seqid_1474 |
| variant_1945 | RKKLFKKIPPPKFLKVALKF | seqid_1475 |
| variant_1946 | FKKLFKKIPPPKFLKVALKF | seqid_1476 |
| variant_1947 | KWKLFKKIPPPKFLKVALKF | seqid_1477 |
| variant_1948 | RWKLFKKIPPPKFLKVALKF | seqid_1478 |
| variant_1949 | FWKLFKKIPPPKFLKVALKF | seqid_1479 |
| variant_1950 | KKKKFKKIPPPKFLKVALKF | seqid_1480 |
| variant_1951 | RKKKFKKIPPPKFLKVALKF | seqid_1481 |
| variant_1952 | FKKKFKKIPPPKFLKVALKF | seqid_1482 |
| variant_1953 | KWKKFKKIPPPKFLKVALKF | seqid_1483 |
| variant_1954 | RWKKFKKIPPPKFLKVALKF | seqid_1484 |
| variant_1955 | FWKKFKKIPPPKFLKVALKF | seqid_1485 |
| variant_1956 | KKKLLKKIPPPKFLKVALKF | seqid_1486 |
| variant_1957 | RKKLLKKIPPPKFLKVALKF | seqid_1487 |
| variant_1958 | FKKLLKKIPPPKFLKVALKF | seqid_1488 |
| variant_1959 | KWKLLKKIPPPKFLKVALKF | seqid_1489 |
| variant_1960 | RWKLLKKIPPPKFLKVALKF | seqid_1490 |
| variant_1961 | FWKLLKKIPPPKFLKVALKF | seqid_1491 |
| variant_1962 | KKKKLKKIPPPKFLKVALKF | seqid_1492 |
| variant_1963 | RKKKLKKIPPPKFLKVALKF | seqid_1493 |
| variant_1964 | FKKKLKKIPPPKFLKVALKF | seqid_1494 |
| variant_1965 | KWKKLKKIPPPKFLKVALKF | seqid_1495 |
| variant_1966 | RWKKLKKIPPPKFLKVALKF | seqid_1496 |
| variant_1967 | FWKKLKKIPPPKFLKVALKF | seqid_1497 |
| variant_1968 | KKKLFLKIPPKFLKVALKF | seqid_1498 |
| variant_1969 | RKKLFLKIPPKFLKVALKF | seqid_1499 |
| variant_1970 | FKKLFLKIPPKFLKVALKF | seqid_1500 |
| variant_1971 | KWKLFLKIPPKFLKVALKF | seqid_1501 |
| variant_1972 | RWKLFLKIPPKFLKVALKF | seqid_1502 |
| variant_1973 | FWKLFLKIPPKFLKVALKF | seqid_1503 |
| variant_1974 | KKKKFLKIPPKFLKVALKF | seqid_1504 |
| variant_1975 | RKKKFLKIPPKFLKVALKF | seqid_1505 |
| variant_1976 | FKKKFLKIPPKFLKVALKF | seqid_1506 |
| variant_1977 | KWKKFLKIPPKFLKVALKF | seqid_1507 |
| variant_1978 | RWKKFLKIPPKFLKVALKF | seqid_1508 |
| variant_1979 | FWKKFLKIPPKFLKVALKF | seqid_1509 |
| variant_1980 | KKKLLLKIPPKFLKVALKF | seqid_1510 |
| variant_1981 | RKKLLLKIPPKFLKVALKF | seqid_1511 |
| variant_1982 | FKKLLLKIPPKFLKVALKF | seqid_1512 |
| variant_1983 | KWKLLLKIPPKFLKVALKF | seqid_1513 |
| variant_1984 | RWKLLLKIPPKFLKVALKF | seqid_1514 |
| variant_1985 | FWKLLLKIPPKFLKVALKF | seqid_1515 |
| variant_1986 | KKKKLLKIPPKFLKVALKF | seqid_1516 |
| variant_1987 | RKKKLLKIPPKFLKVALKF | seqid_1517 |
| variant_1988 | FKKKLLKIPPKFLKVALKF | seqid_1518 |
| variant_1989 | KWKKLLKIPPKFLKVALKF | seqid_1519 |
| variant_1990 | RWKKLLKIPPKFLKVALKF | seqid_1520 |
| variant_1991 | FWKKLLKIPPKFLKVALKF | seqid_1521 |
| variant_1992 | KKKLFKKIPPKFLKVALKF | seqid_1522 |
| variant_1993 | RKKLFKKIPPKFLKVALKF | seqid_1523 |
| variant_1994 | FKKLFKKIPPKFLKVALKF | seqid_1524 |
| variant_1995 | KWKLFKKIPPKFLKVALKF | seqid_1525 |
| variant_1996 | RWKLFKKIPPKFLKVALKF | seqid_1526 |
| variant_1997 | FWKLFKKIPPKFLKVALKF | seqid_1527 |
| variant_1998 | KKKKFKKIPPKFLKVALKF | seqid_1528 |
| variant_1999 | RKKKFKKIPPKFLKVALKF | seqid_1529 |
| variant_2000 | FKKKFKKIPPKFLKVALKF | seqid_1530 |
| variant_2001 | KWKKFKKIPPKFLKVALKF | seqid_1531 |
| variant_2002 | RWKKFKKIPPKFLKVALKF | seqid_1532 |

-continued

| | | |
|---|---|---|
| variant_2003 | FWKKFKKIPPKFLKVALKF | seqid_1533 |
| variant_2004 | KKKLLKKIPPKFLKVALKF | seqid_1534 |
| variant_2005 | RKKLLKKIPPKFLKVALKF | seqid_1535 |
| variant_2006 | FKKLLKKIPPKFLKVALKF | seqid_1536 |
| variant_2007 | KWKLLKKIPPKFLKVALKF | seqid_1537 |
| variant_2008 | RWKLLKKIPPKFLKVALKF | seqid_1538 |
| variant_2009 | FWKLLKKIPPKFLKVALKF | seqid_1539 |
| variant_2010 | KKKKLKKIPPKFLKVALKF | seqid_1540 |
| variant_2011 | RKKKLKKIPPKFLKVALKF | seqid_1541 |
| variant_2012 | FKKKLKKIPPKFLKVALKF | seqid_1542 |
| variant_2013 | KWKKLKKIPPKFLKVALKF | seqid_1543 |
| variant_2014 | RWKKLKKIPPKFLKVALKF | seqid_1544 |
| variant_2015 | FWKKLKKIPPKFLKVALKF | seqid_1545 |
| variant_2064 | KKKLFLKIPKFLKVALKF | seqid_1546 |
| variant_2065 | RKKLFLKIPKFLKVALKF | seqid_1547 |
| variant_2066 | FKKLFLKIPKFLKVALKF | seqid_1548 |
| variant_2067 | KWKLFLKIPKFLKVALKF | seqid_1549 |
| variant_2068 | RWKLFLKIPKFLKVALKF | seqid_1550 |
| variant_2069 | FWKLFLKIPKFLKVALKF | seqid_1551 |
| variant_2070 | KKKKFLKIPKFLKVALKF | seqid_1552 |
| variant_2071 | RKKKFLKIPKFLKVALKF | seqid_1553 |
| variant_2072 | FKKKFLKIPKFLKVALKF | seqid_1554 |
| variant_2073 | KWKKFLKIPKFLKVALKF | seqid_1555 |
| variant_2074 | RWKKFLKIPKFLKVALKF | seqid_1556 |
| variant_2075 | FWKKFLKIPKFLKVALKF | seqid_1557 |
| variant_2076 | KKKLLLKIPKFLKVALKF | seqid_1558 |
| variant_2077 | RKKLLLKIPKFLKVALKF | seqid_1559 |
| variant_2078 | FKKLLLKIPKFLKVALKF | seqid_1560 |
| variant_2079 | KWKLLLKIPKFLKVALKF | seqid_1561 |
| variant_2080 | RWKLLLKIPKFLKVALKF | seqid_1562 |
| variant_2081 | FWKLLLKIPKFLKVALKF | seqid_1563 |
| variant_2082 | KKKKLLKIPKFLKVALKF | seqid_1564 |
| variant_2083 | RKKKLLKIPKFLKVALKF | seqid_1565 |
| variant_2084 | FKKKLLKIPKFLKVALKF | seqid_1566 |
| variant_2085 | KWKKLLKIPKFLKVALKF | seqid_1567 |
| variant_2086 | RWKKLLKIPKFLKVALKF | seqid_1568 |
| variant_2087 | FWKKLLKIPKFLKVALKF | seqid_1569 |
| variant_2088 | KKKLFKKIPKFLKVALKF | seqid_1570 |
| variant_2089 | RKKLFKKIPKFLKVALKF | seqid_1571 |
| variant_2090 | FKKLFKKIPKFLKVALKF | seqid_1572 |
| variant_2091 | KWKLFKKIPKFLKVALKF | seqid_1573 |
| variant_2092 | RWKLFKKIPKFLKVALKF | seqid_1574 |
| variant_2093 | FWKLFKKIPKFLKVALKF | seqid_1575 |
| variant_2094 | KKKKFKKIPKFLKVALKF | seqid_1576 |
| variant_2095 | RKKKFKKIPKFLKVALKF | seqid_1577 |
| variant_2096 | FKKKFKKIPKFLKVALKF | seqid_1578 |
| variant_2097 | KWKKFKKIPKFLKVALKF | seqid_1579 |
| variant_2098 | RWKKFKKIPKFLKVALKF | seqid_1580 |
| variant_2099 | FWKKFKKIPKFLKVALKF | seqid_1581 |
| variant_2100 | KKKLLKKIPKFLKVALKF | seqid_1582 |
| variant_2101 | RKKLLKKIPKFLKVALKF | seqid_1583 |
| variant_2102 | FKKLLKKIPKFLKVALKF | seqid_1584 |
| variant_2103 | KWKLLKKIPKFLKVALKF | seqid_1585 |
| variant_2104 | RWKLLKKIPKFLKVALKF | seqid_1586 |
| variant_2105 | FWKLLKKIPKFLKVALKF | seqid_1587 |
| variant_2106 | KKKKLKKIPKFLKVALKF | seqid_1588 |
| variant_2107 | RKKKLKKIPKFLKVALKF | seqid_1589 |
| variant_2108 | FKKKLKKIPKFLKVALKF | seqid_1590 |
| variant_2109 | KWKKLKKIPKFLKVALKF | seqid_1591 |
| variant_2110 | RWKKLKKIPKFLKVALKF | seqid_1592 |
| variant_2111 | FWKKLKKIPKFLKVALKF | seqid_1593 |
| variant_2112 | KKKLFLKIPPPKFKKVALKF | seqid_1594 |
| variant_2113 | RKKLFLKIPPPKFKKVALKF | seqid_1595 |
| variant_2114 | FKKLFLKIPPPKFKKVALKF | seqid_1596 |
| variant_2115 | KWKLFLKIPPPKFKKVALKF | seqid_1597 |
| variant_2116 | RWKLFLKIPPPKFKKVALKF | seqid_1598 |
| variant_2117 | FWKLFLKIPPPKFKKVALKF | seqid_1599 |
| variant_2118 | KKKKFLKIPPPKFKKVALKF | seqid_1600 |
| variant_2119 | RKKKFLKIPPPKFKKVALKF | seqid_1601 |
| variant_2120 | FKKKFLKIPPPKFKKVALKF | seqid_1602 |
| variant_2121 | KWKKFLKIPPPKFKKVALKF | seqid_1603 |
| variant_2122 | RWKKFLKIPPPKFKKVALKF | seqid_1604 |
| variant_2123 | FWKKFLKIPPPKFKKVALKF | seqid_1605 |
| variant_2124 | KKKLLLKIPPPKFKKVALKF | seqid_1606 |
| variant_2125 | RKKLLLKIPPPKFKKVALKF | seqid_1607 |
| variant_2126 | FKKLLLKIPPPKFKKVALKF | seqid_1608 |
| variant_2127 | KWKLLLKIPPPKFKKVALKF | seqid_1609 |
| variant_2128 | RWKLLLKIPPPKFKKVALKF | seqid_1610 |
| variant_2129 | FWKLLLKIPPPKFKKVALKF | seqid_1611 |
| variant_2130 | KKKKLLKIPPPKFKKVALKF | seqid_1612 |
| variant_2131 | RKKKLLKIPPPKFKKVALKF | seqid_1613 |

| | | |
|---|---|---|
| variant_2132 | FKKKLLKIPPPKFKKVALKF | seqid_1614 |
| variant_2133 | KWKKLLKIPPPKFKKVALKF | seqid_1615 |
| variant_2134 | RWKKLLKIPPPKFKKVALKF | seqid_1616 |
| variant_2135 | FWKKLLKIPPPKFKKVALKF | seqid_1617 |
| variant_2136 | KKKLFKKIPPPKFKKVALKF | seqid_1618 |
| variant_2137 | RKKLFKKIPPPKFKKVALKF | seqid_1619 |
| variant_2138 | FKKLFKKIPPPKFKKVALKF | seqid_1620 |
| variant_2139 | KWKLFKKIPPPKFKKVALKF | seqid_1621 |
| variant_2140 | RWKLFKKIPPPKFKKVALKF | seqid_1622 |
| variant_2141 | FWKLFKKIPPPKFKKVALKF | seqid_1623 |
| variant_2142 | KKKKFKKIPPPKFKKVALKF | seqid_1624 |
| variant_2143 | RKKKFKKIPPPKFKKVALKF | seqid_1625 |
| variant_2144 | FKKKFKKIPPPKFKKVALKF | seqid_1626 |
| variant_2145 | KWKKFKKIPPPKFKKVALKF | seqid_1627 |
| variant_2146 | RWKKFKKIPPPKFKKVALKF | seqid_1628 |
| variant_2147 | FWKKFKKIPPPKFKKVALKF | seqid_1629 |
| variant_2148 | KKKLLKKIPPPKFKKVALKF | seqid_1630 |
| variant_2149 | RKKLLKKIPPPKFKKVALKF | seqid_1631 |
| variant_2150 | FKKLLKKIPPPKFKKVALKF | seqid_1632 |
| variant_2151 | KWKLLKKIPPPKFKKVALKF | seqid_1633 |
| variant_2152 | RWKLLKKIPPPKFKKVALKF | seqid_1634 |
| variant_2153 | FWKLLKKIPPPKFKKVALKF | seqid_1635 |
| variant_2154 | KKKKLKKIPPPKFKKVALKF | seqid_1636 |
| variant_2155 | RKKKLKKIPPPKFKKVALKF | seqid_1637 |
| variant_2156 | FKKKLKKIPPPKFKKVALKF | seqid_1638 |
| variant_2157 | KWKKLKKIPPPKFKKVALKF | seqid_1639 |
| variant_2158 | RWKKLKKIPPPKFKKVALKF | seqid_1640 |
| variant_2159 | FWKKLKKIPPPKFKKVALKF | seqid_1641 |
| variant_2160 | KKKLFLKIPPKFKKVALKF | seqid_1642 |
| variant_2161 | RKKLFLKIPPKFKKVALKF | seqid_1643 |
| variant_2162 | FKKLFLKIPPKFKKVALKF | seqid_1644 |
| variant_2163 | KWKLFLKIPPKFKKVALKF | seqid_1645 |
| variant_2164 | RWKLFLKIPPKFKKVALKF | seqid_1646 |
| variant_2165 | FWKLFLKIPPKFKKVALKF | seqid_1647 |
| variant_2166 | KKKKFLKIPPKFKKVALKF | seqid_1648 |
| variant_2167 | RKKKFLKIPPKFKKVALKF | seqid_1649 |
| variant_2168 | FKKKFLKIPPKFKKVALKF | seqid_1650 |
| variant_2169 | KWKKFLKIPPKFKKVALKF | seqid_1651 |
| variant_2170 | RWKKFLKIPPKFKKVALKF | seqid_1652 |
| variant_2171 | FWKKFLKIPPKFKKVALKF | seqid_1653 |
| variant_2172 | KKKLLLKIPPKFKKVALKF | seqid_1654 |
| variant_2173 | RKKLLLKIPPKFKKVALKF | seqid_1655 |
| variant_2174 | FKKLLLKIPPKFKKVALKF | seqid_1656 |
| variant_2175 | KWKLLLKIPPKFKKVALKF | seqid_1657 |
| variant_2176 | RWKLLLKIPPKFKKVALKF | seqid_1658 |
| variant_2177 | FWKLLLKIPPKFKKVALKF | seqid_1659 |
| variant_2178 | KKKKLLKIPPKFKKVALKF | seqid_1660 |
| variant_2179 | RKKKLLKIPPKFKKVALKF | seqid_1661 |
| variant_2180 | FKKKLLKIPPKFKKVALKF | seqid_1662 |
| variant_2181 | KWKKLLKIPPKFKKVALKF | seqid_1663 |
| variant_2182 | RWKKLLKIPPKFKKVALKF | seqid_1664 |
| variant_2183 | FWKKLLKIPPKFKKVALKF | seqid_1665 |
| variant_2184 | KKKLFKKIPPKFKKVALKF | seqid_1666 |
| variant_2185 | RKKLFKKIPPKFKKVALKF | seqid_1667 |
| variant_2186 | FKKLFKKIPPKFKKVALKF | seqid_1668 |
| variant_2187 | KWKLFKKIPPKFKKVALKF | seqid_1669 |
| variant_2188 | RWKLFKKIPPKFKKVALKF | seqid_1670 |
| variant_2189 | FWKLFKKIPPKFKKVALKF | seqid_1671 |
| variant_2190 | KKKKFKKIPPKFKKVALKF | seqid_1672 |
| variant_2191 | RKKKFKKIPPKFKKVALKF | seqid_1673 |
| variant_2192 | FKKKFKKIPPKFKKVALKF | seqid_1674 |
| variant_2193 | KWKKFKKIPPKFKKVALKF | seqid_1675 |
| variant_2194 | RWKKFKKIPPKFKKVALKF | seqid_1676 |
| variant_2195 | FWKKFKKIPPKFKKVALKF | seqid_1677 |
| variant_2196 | KKKLLKKIPPKFKKVALKF | seqid_1678 |
| variant_2197 | RKKLLKKIPPKFKKVALKF | seqid_1679 |
| variant_2198 | FKKLLKKIPPKFKKVALKF | seqid_1680 |
| variant_2199 | KWKLLKKIPPKFKKVALKF | seqid_1681 |
| variant_2200 | RWKLLKKIPPKFKKVALKF | seqid_1682 |
| variant_2201 | FWKLLKKIPPKFKKVALKF | seqid_1683 |
| variant_2202 | KKKKLKKIPPKFKKVALKF | seqid_1684 |
| variant_2203 | RKKKLKKIPPKFKKVALKF | seqid_1685 |
| variant_2204 | FKKKLKKIPPKFKKVALKF | seqid_1686 |
| variant_2205 | KWKKLKKIPPKFKKVALKF | seqid_1687 |
| variant_2206 | RWKKLKKIPPKFKKVALKF | seqid_1688 |
| variant_2207 | FWKKLKKIPPKFKKVALKF | seqid_1689 |
| variant_2256 | KKKLFLKIPKFKKVALKF | seqid_1690 |
| variant_2257 | RKKLFLKIPKFKKVALKF | seqid_1691 |
| variant_2258 | FKKLFLKIPKFKKVALKF | seqid_1692 |
| variant_2259 | KWKLFLKIPKFKKVALKF | seqid_1693 |
| variant_2260 | RWKLFLKIPKFKKVALKF | seqid_1694 |

-continued

| variant_2261 | FWKLFLKIPKFKKVALKF | seqid_1695 |
| variant_2262 | KKKKFLKIPKFKKVALKF | seqid_1696 |
| variant_2263 | RKKKFLKIPKFKKVALKF | seqid_1697 |
| variant_2264 | FKKKFLKIPKFKKVALKF | seqid_1698 |
| variant_2265 | KWKKFLKIPKFKKVALKF | seqid_1699 |
| variant_2266 | RWKKFLKIPKFKKVALKF | seqid_1700 |
| variant_2267 | FWKKFLKIPKFKKVALKF | seqid_1701 |
| variant_2268 | KKKLLLKIPKFKKVALKF | seqid_1702 |
| variant_2269 | RKKLLLKIPKFKKVALKF | seqid_1703 |
| variant_2270 | FKKLLLKIPKFKKVALKF | seqid_1704 |
| variant_2271 | KWKLLLKIPKFKKVALKF | seqid_1705 |
| variant_2272 | RWKLLLKIPKFKKVALKF | seqid_1706 |
| variant_2273 | FWKLLLKIPKFKKVALKF | seqid_1707 |
| variant_2274 | KKKKLLKIPKFKKVALKF | seqid_1708 |
| variant_2275 | RKKKLLKIPKFKKVALKF | seqid_1709 |
| variant_2276 | FKKKLLKIPKFKKVALKF | seqid_1710 |
| variant_2277 | KWKKLLKIPKFKKVALKF | seqid_1711 |
| variant_2278 | RWKKLLKIPKFKKVALKF | seqid_1712 |
| variant_2279 | FWKKLLKIPKFKKVALKF | seqid_1713 |
| variant_2280 | KKKLFKKIPKFKKVALKF | seqid_1714 |
| variant_2281 | RKKLFKKIPKFKKVALKF | seqid_1715 |
| variant_2282 | FKKLFKKIPKFKKVALKF | seqid_1716 |
| variant_2283 | KWKLFKKIPKFKKVALKF | seqid_1717 |
| variant_2284 | RWKLFKKIPKFKKVALKF | seqid_1718 |
| variant_2285 | FWKLFKKIPKFKKVALKF | seqid_1719 |
| variant_2286 | KKKKFKKIPKFKKVALKF | seqid_1720 |
| variant_2287 | RKKKFKKIPKFKKVALKF | seqid_1721 |
| variant_2288 | FKKKFKKIPKFKKVALKF | seqid_1722 |
| variant_2289 | KWKKFKKIPKFKKVALKF | seqid_1723 |
| variant_2290 | RWKKFKKIPKFKKVALKF | seqid_1724 |
| variant_2291 | FWKKFKKIPKFKKVALKF | seqid_1725 |
| variant_2292 | KKKLLKKIPKFKKVALKF | seqid_1726 |
| variant_2293 | RKKLLKKIPKFKKVALKF | seqid_1727 |
| variant_2294 | FKKLLKKIPKFKKVALKF | seqid_1728 |
| variant_2295 | KWKLLKKIPKFKKVALKF | seqid_1729 |
| variant_2296 | RWKLLKKIPKFKKVALKF | seqid_1730 |
| variant_2297 | FWKLLKKIPKFKKVALKF | seqid_1731 |
| variant_2298 | KKKKLKKIPKFKKVALKF | seqid_1732 |
| variant_2299 | RKKKLKKIPKFKKVALKF | seqid_1733 |
| variant_2300 | FKKKLKKIPKFKKVALKF | seqid_1734 |
| variant_2301 | KWKKLKKIPKFKKVALKF | seqid_1735 |
| variant_2302 | RWKKLKKIPKFKKVALKF | seqid_1736 |
| variant_2303 | FWKKLKKIPKFKKVALKF | seqid_1737 |
| variant_2304 | KKKLFLKIPPPKFLHSALKF | seqid_1738 |
| variant_2305 | RKKLFLKIPPPKFLHSALKF | seqid_1739 |
| variant_2306 | FKKLFLKIPPPKFLHSALKF | seqid_1740 |
| variant_2307 | KWKLFLKIPPPKFLHSALKF | seqid_1741 |
| variant_2308 | RWKLFLKIPPPKFLHSALKF | seqid_1742 |
| variant_2309 | FWKLFLKIPPPKFLHSALKF | seqid_1743 |
| variant_2310 | KKKKFLKIPPPKFLHSALKF | seqid_1744 |
| variant_2311 | RKKKFLKIPPPKFLHSALKF | seqid_1745 |
| variant_2312 | FKKKFLKIPPPKFLHSALKF | seqid_1746 |
| variant_2313 | KWKKFLKIPPPKFLHSALKF | seqid_1747 |
| variant_2314 | RWKKFLKIPPPKFLHSALKF | seqid_1748 |
| variant_2315 | FWKKFLKIPPPKFLHSALKF | seqid_1749 |
| variant_2316 | KKKLLLKIPPPKFLHSALKF | seqid_1750 |
| variant_2317 | RKKLLLKIPPPKFLHSALKF | seqid_1751 |
| variant_2318 | FKKLLLKIPPPKFLHSALKF | seqid_1752 |
| variant_2319 | KWKLLLKIPPPKFLHSALKF | seqid_1753 |
| variant_2320 | RWKLLLKIPPPKFLHSALKF | seqid_1754 |
| variant_2321 | FWKLLLKIPPPKFLHSALKF | seqid_1755 |
| variant_2322 | KKKKLLKIPPPKFLHSALKF | seqid_1756 |
| variant_2323 | RKKKLLKIPPPKFLHSALKF | seqid_1757 |
| variant_2324 | FKKKLLKIPPPKFLHSALKF | seqid_1758 |
| variant_2325 | KWKKLLKIPPPKFLHSALKF | seqid_1759 |
| variant_2326 | RWKKLLKIPPPKFLHSALKF | seqid_1760 |
| variant_2327 | FWKKLLKIPPPKFLHSALKF | seqid_1761 |
| variant_2328 | KKKLFKKIPPPKFLHSALKF | seqid_1762 |
| variant_2329 | RKKLFKKIPPPKFLHSALKF | seqid_1763 |
| variant_2330 | FKKLFKKIPPPKFLHSALKF | seqid_1764 |
| variant_2331 | KWKLFKKIPPPKFLHSALKF | seqid_1765 |
| variant_2332 | RWKLFKKIPPPKFLHSALKF | seqid_1766 |
| variant_2333 | FWKLFKKIPPPKFLHSALKF | seqid_1767 |
| variant_2334 | KKKKFKKIPPPKFLHSALKF | seqid_1768 |
| variant_2335 | RKKKFKKIPPPKFLHSALKF | seqid_1769 |
| variant_2336 | FKKKFKKIPPPKFLHSALKF | seqid_1770 |
| variant_2337 | KWKKFKKIPPPKFLHSALKF | seqid_1771 |
| variant_2338 | RWKKFKKIPPPKFLHSALKF | seqid_1772 |
| variant_2339 | FWKKFKKIPPPKFLHSALKF | seqid_1773 |
| variant_2340 | KKKLLKKIPPPKFLHSALKF | seqid_1774 |
| variant_2341 | RKKLLKKIPPPKFLHSALKF | seqid_1775 |

| | | |
|---|---|---|
| variant_2342 | FKKLLKKIPPPKFLHSALKF | seqid_1776 |
| variant_2343 | KWKLLKKIPPPKFLHSALKF | seqid_1777 |
| variant_2344 | RWKLLKKIPPPKFLHSALKF | seqid_1778 |
| variant_2345 | FWKLLKKIPPPKFLHSALKF | seqid_1779 |
| variant_2346 | KKKKLKKIPPPKFLHSALKF | seqid_1780 |
| variant_2347 | RKKKLKKIPPPKFLHSALKF | seqid_1781 |
| variant_2348 | FKKKLKKIPPPKFLHSALKF | seqid_1782 |
| variant_2349 | KWKKLKKIPPPKFLHSALKF | seqid_1783 |
| variant_2350 | RWKKLKKIPPPKFLHSALKF | seqid_1784 |
| variant_2351 | FWKKLKKIPPPKFLHSALKF | seqid_1785 |
| variant_2352 | KKKLFLKIPPKFLHSALKF | seqid_1786 |
| variant_2353 | RKKLFLKIPPKFLHSALKF | seqid_1787 |
| variant_2354 | FKKLFLKIPPKFLHSALKF | seqid_1788 |
| variant_2355 | KWKLFLKIPPKFLHSALKF | seqid_1789 |
| variant_2356 | RWKLFLKIPPKFLHSALKF | seqid_1790 |
| variant_2357 | FWKLFLKIPPKFLHSALKF | seqid_1791 |
| variant_2358 | KKKKFLKIPPKFLHSALKF | seqid_1792 |
| variant_2359 | RKKKFLKIPPKFLHSALKF | seqid_1793 |
| variant_2360 | FKKKFLKIPPKFLHSALKF | seqid_1794 |
| variant_2361 | KWKKFLKIPPKFLHSALKF | seqid_1795 |
| variant_2362 | RWKKFLKIPPKFLHSALKF | seqid_1796 |
| variant_2363 | FWKKFLKIPPKFLHSALKF | seqid_1797 |
| variant_2364 | KKKLLLKIPPKFLHSALKF | seqid_1798 |
| variant_2365 | RKKLLLKIPPKFLHSALKF | seqid_1799 |
| variant_2366 | FKKLLLKIPPKFLHSALKF | seqid_1800 |
| variant_2367 | KWKLLLKIPPKFLHSALKF | seqid_1801 |
| variant_2368 | RWKLLLKIPPKFLHSALKF | seqid_1802 |
| variant_2369 | FWKLLLKIPPKFLHSALKF | seqid_1803 |
| variant_2370 | KKKKLLKIPPKFLHSALKF | seqid_1804 |
| variant_2371 | RKKKLLKIPPKFLHSALKF | seqid_1805 |
| variant_2372 | FKKKLLKIPPKFLHSALKF | seqid_1806 |
| variant_2373 | KWKKLLKIPPKFLHSALKF | seqid_1807 |
| variant_2374 | RWKKLLKIPPKFLHSALKF | seqid_1808 |
| variant_2375 | FWKKLLKIPPKFLHSALKF | seqid_1809 |
| variant_2376 | KKKLFKKIPPKFLHSALKF | seqid_1810 |
| variant_2377 | RKKLFKKIPPKFLHSALKF | seqid_1811 |
| variant_2378 | FKKLFKKIPPKFLHSALKF | seqid_1812 |
| variant_2379 | KWKLFKKIPPKFLHSALKF | seqid_1813 |
| variant_2380 | RWKLFKKIPPKFLHSALKF | seqid_1814 |
| variant_2381 | FWKLFKKIPPKFLHSALKF | seqid_1815 |
| variant_2382 | KKKKFKKIPPKFLHSALKF | seqid_1816 |
| variant_2383 | RKKKFKKIPPKFLHSALKF | seqid_1817 |
| variant_2384 | FKKKFKKIPPKFLHSALKF | seqid_1818 |
| variant_2385 | KWKKFKKIPPKFLHSALKF | seqid_1819 |
| variant_2386 | RWKKFKKIPPKFLHSALKF | seqid_1820 |
| variant_2387 | FWKKFKKIPPKFLHSALKF | seqid_1821 |
| variant_2388 | KKKLLKKIPPKFLHSALKF | seqid_1822 |
| variant_2389 | RKKLLKKIPPKFLHSALKF | seqid_1823 |
| variant_2390 | FKKLLKKIPPKFLHSALKF | seqid_1824 |
| variant_2391 | KWKLLKKIPPKFLHSALKF | seqid_1825 |
| variant_2392 | RWKLLKKIPPKFLHSALKF | seqid_1826 |
| variant_2393 | FWKLLKKIPPKFLHSALKF | seqid_1827 |
| variant_2394 | KKKKLKKIPPKFLHSALKF | seqid_1828 |
| variant_2395 | RKKKLKKIPPKFLHSALKF | seqid_1829 |
| variant_2396 | FKKKLKKIPPKFLHSALKF | seqid_1830 |
| variant_2397 | KWKKLKKIPPKFLHSALKF | seqid_1831 |
| variant_2398 | RWKKLKKIPPKFLHSALKF | seqid_1832 |
| variant_2399 | FWKKLKKIPPKFLHSALKF | seqid_1833 |
| variant_2448 | KKKLFLKIPKFLHSALKF | seqid_1834 |
| variant_2449 | RKKLFLKIPKFLHSALKF | seqid_1835 |
| variant_2450 | FKKLFLKIPKFLHSALKF | seqid_1836 |
| variant_2451 | KWKLFLKIPKFLHSALKF | seqid_1837 |
| variant_2452 | RWKLFLKIPKFLHSALKF | seqid_1838 |
| variant_2453 | FWKLFLKIPKFLHSALKF | seqid_1839 |
| variant_2454 | KKKKFLKIPKFLHSALKF | seqid_1840 |
| variant_2455 | RKKKFLKIPKFLHSALKF | seqid_1841 |
| variant_2456 | FKKKFLKIPKFLHSALKF | seqid_1842 |
| variant_2457 | KWKKFLKIPKFLHSALKF | seqid_1843 |
| variant_2458 | RWKKFLKIPKFLHSALKF | seqid_1844 |
| variant_2459 | FWKKFLKIPKFLHSALKF | seqid_1845 |
| variant_2460 | KKKLLLKIPKFLHSALKF | seqid_1846 |
| variant_2461 | RKKLLLKIPKFLHSALKF | seqid_1847 |
| variant_2462 | FKKLLLKIPKFLHSALKF | seqid_1848 |
| variant_2463 | KWKLLLKIPKFLHSALKF | seqid_1849 |
| variant_2464 | RWKLLLKIPKFLHSALKF | seqid_1850 |
| variant_2465 | FWKLLLKIPKFLHSALKF | seqid_1851 |
| variant_2466 | KKKKLLKIPKFLHSALKF | seqid_1852 |
| variant_2467 | RKKKLLKIPKFLHSALKF | seqid_1853 |
| variant_2468 | FKKKLLKIPKFLHSALKF | seqid_1854 |
| variant_2469 | KWKKLLKIPKFLHSALKF | seqid_1855 |
| variant_2470 | RWKKLLKIPKFLHSALKF | seqid_1856 |

-continued

| | | |
|---|---|---|
| variant_2471 | FWKKLLKIPKFLHSALKF | seqid_1857 |
| variant_2472 | KKKLFKKIPKFLHSALKF | seqid_1858 |
| variant_2473 | RKKLFKKIPKFLHSALKF | seqid_1859 |
| variant_2474 | FKKLFKKIPKFLHSALKF | seqid_1860 |
| variant_2475 | KWKLFKKIPKFLHSALKF | seqid_1861 |
| variant_2476 | RWKLFKKIPKFLHSALKF | seqid_1862 |
| variant_2477 | FWKLFKKIPKFLHSALKF | seqid_1863 |
| variant_2478 | KKKKFKKIPKFLHSALKF | seqid_1864 |
| variant_2479 | RKKKFKKIPKFLHSALKF | seqid_1865 |
| variant_2480 | FKKKFKKIPKFLHSALKF | seqid_1866 |
| variant_2481 | KWKKFKKIPKFLHSALKF | seqid_1867 |
| variant_2482 | RWKKFKKIPKFLHSALKF | seqid_1868 |
| variant_2483 | FWKKFKKIPKFLHSALKF | seqid_1869 |
| variant_2484 | KKKLLKKIPKFLHSALKF | seqid_1870 |
| variant_2485 | RKKLLKKIPKFLHSALKF | seqid_1871 |
| variant_2486 | FKKLLKKIPKFLHSALKF | seqid_1872 |
| variant_2487 | KWKLLKKIPKFLHSALKF | seqid_1873 |
| variant_2488 | RWKLLKKIPKFLHSALKF | seqid_1874 |
| variant_2489 | FWKLLKKIPKFLHSALKF | seqid_1875 |
| variant_2490 | KKKKLKKIPKFLHSALKF | seqid_1876 |
| variant_2491 | RKKKLKKIPKFLHSALKF | seqid_1877 |
| variant_2492 | FKKKLKKIPKFLHSALKF | seqid_1878 |
| variant_2493 | KWKKLKKIPKFLHSALKF | seqid_1879 |
| variant_2494 | RWKKLKKIPKFLHSALKF | seqid_1880 |
| variant_2495 | FWKKLKKIPKFLHSALKF | seqid_1881 |
| variant_2496 | KKKLFLKIPPPKFKHSALKF | seqid_1882 |
| variant_2497 | RKKLFLKIPPPKFKHSALKF | seqid_1883 |
| variant_2498 | FKKLFLKIPPPKFKHSALKF | seqid_1884 |
| variant_2499 | KWKLFLKIPPPKFKHSALKF | seqid_1885 |
| variant_2500 | RWKLFLKIPPPKFKHSALKF | seqid_1886 |
| variant_2501 | FWKLFLKIPPPKFKHSALKF | seqid_1887 |
| variant_2502 | KKKKFLKIPPPKFKHSALKF | seqid_1888 |
| variant_2503 | RKKKFLKIPPPKFKHSALKF | seqid_1889 |
| variant_2504 | FKKKFLKIPPPKFKHSALKF | seqid_1890 |
| variant_2505 | KWKKFLKIPPPKFKHSALKF | seqid_1891 |
| variant_2506 | RWKKFLKIPPPKFKHSALKF | seqid_1892 |
| variant_2507 | FWKKFLKIPPPKFKHSALKF | seqid_1893 |
| variant_2508 | KKKLLLKIPPPKFKHSALKF | seqid_1894 |
| variant_2509 | RKKLLLKIPPPKFKHSALKF | seqid_1895 |
| variant_2510 | FKKLLLKIPPPKFKHSALKF | seqid_1896 |
| variant_2511 | KWKLLLKIPPPKFKHSALKF | seqid_1897 |
| variant_2512 | RWKLLLKIPPPKFKHSALKF | seqid_1898 |
| variant_2513 | FWKLLLKIPPPKFKHSALKF | seqid_1899 |
| variant_2514 | KKKKLLKIPPPKFKHSALKF | seqid_1900 |
| variant_2515 | RKKKLLKIPPPKFKHSALKF | seqid_1901 |
| variant_2516 | FKKKLLKIPPPKFKHSALKF | seqid_1902 |
| variant_2517 | KWKKLLKIPPPKFKHSALKF | seqid_1903 |
| variant_2518 | RWKKLLKIPPPKFKHSALKF | seqid_1904 |
| variant_2519 | FWKKLLKIPPPKFKHSALKF | seqid_1905 |
| variant_2520 | KKKLFKKIPPPKFKHSALKF | seqid_1906 |
| variant_2521 | RKKLFKKIPPPKFKHSALKF | seqid_1907 |
| variant_2522 | FKKLFKKIPPPKFKHSALKF | seqid_1908 |
| variant_2523 | KWKLFKKIPPPKFKHSALKF | seqid_1909 |
| variant_2524 | RWKLFKKIPPPKFKHSALKF | seqid_1910 |
| variant_2525 | FWKLFKKIPPPKFKHSALKF | seqid_1911 |
| variant_2526 | KKKKFKKIPPPKFKHSALKF | seqid_1912 |
| variant_2527 | RKKKFKKIPPPKFKHSALKF | seqid_1913 |
| variant_2528 | FKKKFKKIPPPKFKHSALKF | seqid_1914 |
| variant_2529 | KWKKFKKIPPPKFKHSALKF | seqid_1915 |
| variant_2530 | RWKKFKKIPPPKFKHSALKF | seqid_1916 |
| variant_2531 | FWKKFKKIPPPKFKHSALKF | seqid_1917 |
| variant_2532 | KKKLLKKIPPPKFKHSALKF | seqid_1918 |
| variant_2533 | RKKLLKKIPPPKFKHSALKF | seqid_1919 |
| variant_2534 | FKKLLKKIPPPKFKHSALKF | seqid_1920 |
| variant_2535 | KWKLLKKIPPPKFKHSALKF | seqid_1921 |
| variant_2536 | RWKLLKKIPPPKFKHSALKF | seqid_1922 |
| variant_2537 | FWKLLKKIPPPKFKHSALKF | seqid_1923 |
| variant_2538 | KKKKLKKIPPPKFKHSALKF | seqid_1924 |
| variant_2539 | RKKKLKKIPPPKFKHSALKF | seqid_1925 |
| variant_2540 | FKKKLKKIPPPKFKHSALKF | seqid_1926 |
| variant_2541 | KWKKLKKIPPPKFKHSALKF | seqid_1927 |
| variant_2542 | RWKKLKKIPPPKFKHSALKF | seqid_1928 |
| variant_2543 | FWKKLKKIPPPKFKHSALKF | seqid_1929 |
| variant_2544 | KKKLFLKIPPKFKHSALKF | seqid_1930 |
| variant_2545 | RKKLFLKIPPKFKHSALKF | seqid_1931 |
| variant_2546 | FKKLFLKIPPKFKHSALKF | seqid_1932 |
| variant_2547 | KWKLFLKIPPKFKHSALKF | seqid_1933 |
| variant_2548 | RWKLFLKIPPKFKHSALKF | seqid_1934 |
| variant_2549 | FWKLFLKIPPKFKHSALKF | seqid_1935 |
| variant_2550 | KKKKFLKIPPKFKHSALKF | seqid_1936 |
| variant_2551 | RKKKFLKIPPKFKHSALKF | seqid_1937 |

| | | |
|---|---|---|
| variant_2552 | FKKKFLKIPPKFKHSALKF | seqid_1938 |
| variant_2553 | KWKKFLKIPPKFKHSALKF | seqid_1939 |
| variant_2554 | RWKKFLKIPPKFKHSALKF | seqid_1940 |
| variant_2555 | FWKKFLKIPPKFKHSALKF | seqid_1941 |
| variant_2556 | KKKLLLKIPPKFKHSALKF | seqid_1942 |
| variant_2557 | RKKLLLKIPPKFKHSALKF | seqid_1943 |
| variant_2558 | FKKLLLKIPPKFKHSALKF | seqid_1944 |
| variant_2559 | KWKLLLKIPPKFKHSALKF | seqid_1945 |
| variant_2560 | RWKLLLKIPPKFKHSALKF | seqid_1946 |
| variant_2561 | FWKLLLKIPPKFKHSALKF | seqid_1947 |
| variant_2562 | KKKKLLKIPPKFKHSALKF | seqid_1948 |
| variant_2563 | RKKKLLKIPPKFKHSALKF | seqid_1949 |
| variant_2564 | FKKKLLKIPPKFKHSALKF | seqid_1950 |
| variant_2565 | KWKKLLKIPPKFKHSALKF | seqid_1951 |
| variant_2566 | RWKKLLKIPPKFKHSALKF | seqid_1952 |
| variant_2567 | FWKKLLKIPPKFKHSALKF | seqid_1953 |
| variant_2568 | KKKLFKKIPPKFKHSALKF | seqid_1954 |
| variant_2569 | RKKLFKKIPPKFKHSALKF | seqid_1955 |
| variant_2570 | FKKLFKKIPPKFKHSALKF | seqid_1956 |
| variant_2571 | KWKLFKKIPPKFKHSALKF | seqid_1957 |
| variant_2572 | RWKLFKKIPPKFKHSALKF | seqid_1958 |
| variant_2573 | FWKLFKKIPPKFKHSALKF | seqid_1959 |
| variant_2574 | KKKKFKKIPPKFKHSALKF | seqid_1960 |
| variant_2575 | RKKKFKKIPPKFKHSALKF | seqid_1961 |
| variant_2576 | FKKKFKKIPPKFKHSALKF | seqid_1962 |
| variant_2577 | KWKKFKKIPPKFKHSALKF | seqid_1963 |
| variant_2578 | RWKKFKKIPPKFKHSALKF | seqid_1964 |
| variant_2579 | FWKKFKKIPPKFKHSALKF | seqid_1965 |
| variant_2580 | KKKLLKKIPPKFKHSALKF | seqid_1966 |
| variant_2581 | RKKLLKKIPPKFKHSALKF | seqid_1967 |
| variant_2582 | FKKLLKKIPPKFKHSALKF | seqid_1968 |
| variant_2583 | KWKLLKKIPPKFKHSALKF | seqid_1969 |
| variant_2584 | RWKLLKKIPPKFKHSALKF | seqid_1970 |
| variant_2585 | FWKLLKKIPPKFKHSALKF | seqid_1971 |
| variant_2586 | KKKKLKKIPPKFKHSALKF | seqid_1972 |
| variant_2587 | RKKKLKKIPPKFKHSALKF | seqid_1973 |
| variant_2588 | FKKKLKKIPPKFKHSALKF | seqid_1974 |
| variant_2589 | KWKKLKKIPPKFKHSALKF | seqid_1975 |
| variant_2590 | RWKKLKKIPPKFKHSALKF | seqid_1976 |
| variant_2591 | FWKKLKKIPPKFKHSALKF | seqid_1977 |
| variant_2640 | KKKLFLKIPKFKHSALKF | seqid_1978 |
| variant_2641 | RKKLFLKIPKFKHSALKF | seqid_1979 |
| variant_2642 | FKKLFLKIPKFKHSALKF | seqid_1980 |
| variant_2643 | KWKLFLKIPKFKHSALKF | seqid_1981 |
| variant_2644 | RWKLFLKIPKFKHSALKF | seqid_1982 |
| variant_2645 | FWKLFLKIPKFKHSALKF | seqid_1983 |
| variant_2646 | KKKKFLKIPKFKHSALKF | seqid_1984 |
| variant_2647 | RKKKFLKIPKFKHSALKF | seqid_1985 |
| variant_2648 | FKKKFLKIPKFKHSALKF | seqid_1986 |
| variant_2649 | KWKKFLKIPKFKHSALKF | seqid_1987 |
| variant_2650 | RWKKFLKIPKFKHSALKF | seqid_1988 |
| variant_2651 | FWKKFLKIPKFKHSALKF | seqid_1989 |
| variant_2652 | KKKLLLKIPKFKHSALKF | seqid_1990 |
| variant_2653 | RKKLLLKIPKFKHSALKF | seqid_1991 |
| variant_2654 | FKKLLLKIPKFKHSALKF | seqid_1992 |
| variant_2655 | KWKLLLKIPKFKHSALKF | seqid_1993 |
| variant_2656 | RWKLLLKIPKFKHSALKF | seqid_1994 |
| variant_2657 | FWKLLLKIPKFKHSALKF | seqid_1995 |
| variant_2658 | KKKKLLKIPKFKHSALKF | seqid_1996 |
| variant_2659 | RKKKLLKIPKFKHSALKF | seqid_1997 |
| variant_2660 | FKKKLLKIPKFKHSALKF | seqid_1998 |
| variant_2661 | KWKKLLKIPKFKHSALKF | seqid_1999 |
| variant_2662 | RWKKLLKIPKFKHSALKF | seqid_2000 |
| variant_2663 | FWKKLLKIPKFKHSALKF | seqid_2001 |
| variant_2664 | KKKLFKKIPKFKHSALKF | seqid_2002 |
| variant_2665 | RKKLFKKIPKFKHSALKF | seqid_2003 |
| variant_2666 | FKKLFKKIPKFKHSALKF | seqid_2004 |
| variant_2667 | KWKLFKKIPKFKHSALKF | seqid_2005 |
| variant_2668 | RWKLFKKIPKFKHSALKF | seqid_2006 |
| variant_2669 | FWKLFKKIPKFKHSALKF | seqid_2007 |
| variant_2670 | KKKKFKKIPKFKHSALKF | seqid_2008 |
| variant_2671 | RKKKFKKIPKFKHSALKF | seqid_2009 |
| variant_2672 | FKKKFKKIPKFKHSALKF | seqid_2010 |
| variant_2673 | KWKKFKKIPKFKHSALKF | seqid_2011 |
| variant_2674 | RWKKFKKIPKFKHSALKF | seqid_2012 |
| variant_2675 | FWKKFKKIPKFKHSALKF | seqid_2013 |
| variant_2676 | KKKLLKKIPKFKHSALKF | seqid_2014 |
| variant_2677 | RKKLLKKIPKFKHSALKF | seqid_2015 |
| variant_2678 | FKKLLKKIPKFKHSALKF | seqid_2016 |
| variant_2679 | KWKLLKKIPKFKHSALKF | seqid_2017 |
| variant_2680 | RWKLLKKIPKFKHSALKF | seqid_2018 |

-continued

| | | |
|---|---|---|
| variant_2681 | FWKLLKKIPKFKHSALKF | seqid_2019 |
| variant_2682 | KKKKLKKIPKFKHSALKF | seqid_2020 |
| variant_2683 | RKKKLKKIPKFKHSALKF | seqid_2021 |
| variant_2684 | FKKKLKKIPKFKHSALKF | seqid_2022 |
| variant_2685 | KWKKLKKIPKFKHSALKF | seqid_2023 |
| variant_2686 | RWKKLKKIPKFKHSALKF | seqid_2024 |
| variant_2687 | FWKKLKKIPKFKHSALKF | seqid_2025 |
| variant_2688 | KKKLFLKIPPPKFLKSALKF | seqid_2026 |
| variant_2689 | RKKLFLKIPPPKFLKSALKF | seqid_2027 |
| variant_2690 | FKKLFLKIPPPKFLKSALKF | seqid_2028 |
| variant_2691 | KWKLFLKIPPPKFLKSALKF | seqid_2029 |
| variant_2692 | RWKLFLKIPPPKFLKSALKF | seqid_2030 |
| variant_2693 | FWKLFLKIPPPKFLKSALKF | seqid_2031 |
| variant_2694 | KKKKFLKIPPPKFLKSALKF | seqid_2032 |
| variant_2695 | RKKKFLKIPPPKFLKSALKF | seqid_2033 |
| variant_2696 | FKKKFLKIPPPKFLKSALKF | seqid_2034 |
| variant_2697 | KWKKFLKIPPPKFLKSALKF | seqid_2035 |
| variant_2698 | RWKKFLKIPPPKFLKSALKF | seqid_2036 |
| variant_2699 | FWKKFLKIPPPKFLKSALKF | seqid_2037 |
| variant_2700 | KKKLLLKIPPPKFLKSALKF | seqid_2038 |
| variant_2701 | RKKLLLKIPPPKFLKSALKF | seqid_2039 |
| variant_2702 | FKKLLLKIPPPKFLKSALKF | seqid_2040 |
| variant_2703 | KWKLLLKIPPPKFLKSALKF | seqid_2041 |
| variant_2704 | RWKLLLKIPPPKFLKSALKF | seqid_2042 |
| variant_2705 | FWKLLLKIPPPKFLKSALKF | seqid_2043 |
| variant_2706 | KKKKLLKIPPPKFLKSALKF | seqid_2044 |
| variant_2707 | RKKKLLKIPPPKFLKSALKF | seqid_2045 |
| variant_2708 | FKKKLLKIPPPKFLKSALKF | seqid_2046 |
| variant_2709 | KWKKLLKIPPPKFLKSALKF | seqid_2047 |
| variant_2710 | RWKKLLKIPPPKFLKSALKF | seqid_2048 |
| variant_2711 | FWKKLLKIPPPKFLKSALKF | seqid_2049 |
| variant_2712 | KKKLFKKIPPPKFLKSALKF | seqid_2050 |
| variant_2713 | RKKLFKKIPPPKFLKSALKF | seqid_2051 |
| variant_2714 | FKKLFKKIPPPKFLKSALKF | seqid_2052 |
| variant_2715 | KWKLFKKIPPPKFLKSALKF | seqid_2053 |
| variant_2716 | RWKLFKKIPPPKFLKSALKF | seqid_2054 |
| variant_2717 | FWKLFKKIPPPKFLKSALKF | seqid_2055 |
| variant_2718 | KKKKFKKIPPPKFLKSALKF | seqid_2056 |
| variant_2719 | RKKKFKKIPPPKFLKSALKF | seqid_2057 |
| variant_2720 | FKKKFKKIPPPKFLKSALKF | seqid_2058 |
| variant_2721 | KWKKFKKIPPPKFLKSALKF | seqid_2059 |
| variant_2722 | RWKKFKKIPPPKFLKSALKF | seqid_2060 |
| variant_2723 | FWKKFKKIPPPKFLKSALKF | seqid_2061 |
| variant_2724 | KKKLLKKIPPPKFLKSALKF | seqid_2062 |
| variant_2725 | RKKLLKKIPPPKFLKSALKF | seqid_2063 |
| variant_2726 | FKKLLKKIPPPKFLKSALKF | seqid_2064 |
| variant_2727 | KWKLLKKIPPPKFLKSALKF | seqid_2065 |
| variant_2728 | RWKLLKKIPPPKFLKSALKF | seqid_2066 |
| variant_2729 | FWKLLKKIPPPKFLKSALKF | seqid_2067 |
| variant_2730 | KKKKLKKIPPPKFLKSALKF | seqid_2068 |
| variant_2731 | RKKKLKKIPPPKFLKSALKF | seqid_2069 |
| variant_2732 | FKKKLKKIPPPKFLKSALKF | seqid_2070 |
| variant_2733 | KWKKLKKIPPPKFLKSALKF | seqid_2071 |
| variant_2734 | RWKKLKKIPPPKFLKSALKF | seqid_2072 |
| variant_2735 | FWKKLKKIPPPKFLKSALKF | seqid_2073 |
| variant_2736 | KKKLFLKIPPKFLKSALKF | seqid_2074 |
| variant_2737 | RKKLFLKIPPKFLKSALKF | seqid_2075 |
| variant_2738 | FKKLFLKIPPPKFLKSALKF | seqid_2076 |
| variant_2739 | KWKLFLKIPPKFLKSALKF | seqid_2077 |
| variant_2740 | RWKLFLKIPPKFLKSALKF | seqid_2078 |
| variant_2741 | FWKLFLKIPPKFLKSALKF | seqid_2079 |
| variant_2742 | KKKKFLKIPPKFLKSALKF | seqid_2080 |
| variant_2743 | RKKKFLKIPPKFLKSALKF | seqid_2081 |
| variant_2744 | FKKKFLKIPPKFLKSALKF | seqid_2082 |
| variant_2745 | KWKKFLKIPPKFLKSALKF | seqid_2083 |
| variant_2746 | RWKKFLKIPPKFLKSALKF | seqid_2084 |
| variant_2747 | FWKKFLKIPPKFLKSALKF | seqid_2085 |
| variant_2748 | KKKLLLKIPPKFLKSALKF | seqid_2086 |
| variant_2749 | RKKLLLKIPPKFLKSALKF | seqid_2087 |
| variant_2750 | FKKLLLKIPPKFLKSALKF | seqid_2088 |
| variant_2751 | KWKLLLKIPPKFLKSALKF | seqid_2089 |
| variant_2752 | RWKLLLKIPPKFLKSALKF | seqid_2090 |
| variant_2753 | FWKLLLKIPPKFLKSALKF | seqid_2091 |
| variant_2754 | KKKKLLKIPPKFLKSALKF | seqid_2092 |
| variant_2755 | RKKKLLKIPPKFLKSALKF | seqid_2093 |
| variant_2756 | FKKKLLKIPPKFLKSALKF | seqid_2094 |
| variant_2757 | KWKKLLKIPPKFLKSALKF | seqid_2095 |
| variant_2758 | RWKKLLKIPPKFLKSALKF | seqid_2096 |
| variant_2759 | FWKKLLKIPPKFLKSALKF | seqid_2097 |
| variant_2760 | KKKLFKKIPPKFLKSALKF | seqid_2098 |
| variant_2761 | RKKLFKKIPPKFLKSALKF | seqid_2099 |

| | | |
|---|---|---|
| variant_2762 | FKKLFKKIPPKFLKSALKF | seqid_2100 |
| variant_2763 | KWKLFKKIPPKFLKSALKF | seqid_2101 |
| variant_2764 | RWKLFKKIPPKFLKSALKF | seqid_2102 |
| variant_2765 | FWKLFKKIPPKFLKSALKF | seqid_2103 |
| variant_2766 | KKKKFKKIPPKFLKSALKF | seqid_2104 |
| variant_2767 | RKKKFKKIPPKFLKSALKF | seqid_2105 |
| variant_2768 | FKKKFKKIPPKFLKSALKF | seqid_2106 |
| variant_2769 | KWKKFKKIPPKFLKSALKF | seqid_2107 |
| variant_2770 | RWKKFKKIPPKFLKSALKF | seqid_2108 |
| variant_2771 | FWKKFKKIPPKFLKSALKF | seqid_2109 |
| variant_2772 | KKKLLKKIPPKFLKSALKF | seqid_2110 |
| variant_2773 | RKKLLKKIPPKFLKSALKF | seqid_2111 |
| variant_2774 | FKKLLKKIPPKFLKSALKF | seqid_2112 |
| variant_2775 | KWKLLKKIPPKFLKSALKF | seqid_2113 |
| variant_2776 | RWKLLKKIPPKFLKSALKF | seqid_2114 |
| variant_2777 | FWKLLKKIPPKFLKSALKF | seqid_2115 |
| variant_2778 | KKKKLKKIPPKFLKSALKF | seqid_2116 |
| variant_2779 | RKKKLKKIPPKFLKSALKF | seqid_2117 |
| variant_2780 | FKKKLKKIPPKFLKSALKF | seqid_2118 |
| variant_2781 | KWKKLKKIPPKFLKSALKF | seqid_2119 |
| variant_2782 | RWKKLKKIPPKFLKSALKF | seqid_2120 |
| variant_2783 | FWKKLKKIPPKFLKSALKF | seqid_2121 |
| variant_2832 | KKKLFLKIPKFLKSALKF | seqid_2122 |
| variant_2833 | RKKLFLKIPKFLKSALKF | seqid_2123 |
| variant_2834 | FKKLFLKIPKFLKSALKF | seqid_2124 |
| variant_2835 | KWKLFLKIPKFLKSALKF | seqid_2125 |
| variant_2836 | RWKLFLKIPKFLKSALKF | seqid_2126 |
| variant_2837 | FWKLFLKIPKFLKSALKF | seqid_2127 |
| variant_2838 | KKKKFLKIPKFLKSALKF | seqid_2128 |
| variant_2839 | RKKKFLKIPKFLKSALKF | seqid_2129 |
| variant_2840 | FKKKFLKIPKFLKSALKF | seqid_2130 |
| variant_2841 | KWKKFLKIPKFLKSALKF | seqid_2131 |
| variant_2842 | RWKKFLKIPKFLKSALKF | seqid_2132 |
| variant_2843 | FWKKFLKIPKFLKSALKF | seqid_2133 |
| variant_2844 | KKKLLLKIPKFLKSALKF | seqid_2134 |
| variant_2845 | RKKLLLKIPKFLKSALKF | seqid_2135 |
| variant_2846 | FKKLLLKIPKFLKSALKF | seqid_2136 |
| variant_2847 | KWKLLLKIPKFLKSALKF | seqid_2137 |
| variant_2848 | RWKLLLKIPKFLKSALKF | seqid_2138 |
| variant_2849 | FWKLLLKIPKFLKSALKF | seqid_2139 |
| variant_2850 | KKKKLLKIPKFLKSALKF | seqid_2140 |
| variant_2851 | RKKKLLKIPKFLKSALKF | seqid_2141 |
| variant_2852 | FKKKLLKIPKFLKSALKF | seqid_2142 |
| variant_2853 | KWKKLLKIPKFLKSALKF | seqid_2143 |
| variant_2854 | RWKKLLKIPKFLKSALKF | seqid_2144 |
| variant_2855 | FWKKLLKIPKFLKSALKF | seqid_2145 |
| variant_2856 | KKKLFKKIPKFLKSALKF | seqid_2146 |
| variant_2857 | RKKLFKKIPKFLKSALKF | seqid_2147 |
| variant_2858 | FKKLFKKIPKFLKSALKF | seqid_2148 |
| variant_2859 | KWKLFKKIPKFLKSALKF | seqid_2149 |
| variant_2860 | RWKLFKKIPKFLKSALKF | seqid_2150 |
| variant_2861 | FWKLFKKIPKFLKSALKF | seqid_2151 |
| variant_2862 | KKKKFKKIPKFLKSALKF | seqid_2152 |
| variant_2863 | RKKKFKKIPKFLKSALKF | seqid_2153 |
| variant_2864 | FKKKFKKIPKFLKSALKF | seqid_2154 |
| variant_2865 | KWKKFKKIPKFLKSALKF | seqid_2155 |
| variant_2866 | RWKKFKKIPKFLKSALKF | seqid_2156 |
| variant_2867 | FWKKFKKIPKFLKSALKF | seqid_2157 |
| variant_2868 | KKKLLKKIPKFLKSALKF | seqid_2158 |
| variant_2869 | RKKLLKKIPKFLKSALKF | seqid_2159 |
| variant_2870 | FKKLLKKIPKFLKSALKF | seqid_2160 |
| variant_2871 | KWKLLKKIPKFLKSALKF | seqid_2161 |
| variant_2872 | RWKLLKKIPKFLKSALKF | seqid_2162 |
| variant_2873 | FWKLLKKIPKFLKSALKF | seqid_2163 |
| variant_2874 | KKKKLKKIPKFLKSALKF | seqid_2164 |
| variant_2875 | RKKKLKKIPKFLKSALKF | seqid_2165 |
| variant_2876 | FKKKLKKIPKFLKSALKF | seqid_2166 |
| variant_2877 | KWKKLKKIPKFLKSALKF | seqid_2167 |
| variant_2878 | RWKKLKKIPKFLKSALKF | seqid_2168 |
| variant_2879 | FWKKLKKIPKFLKSALKF | seqid_2169 |
| variant_2880 | KKKLFLKIPPPKFKKSALKF | seqid_2170 |
| variant_2881 | RKKLFLKIPPPKFKKSALKF | seqid_2171 |
| variant_2882 | FKKLFLKIPPPKFKKSALKF | seqid_2172 |
| variant_2883 | KWKLFLKIPPPKFKKSALKF | seqid_2173 |
| variant_2884 | RWKLFLKIPPPKFKKSALKF | seqid_2174 |
| variant_2885 | FWKLFLKIPPPKFKKSALKF | seqid_2175 |
| variant_2886 | KKKKFLKIPPPKFKKSALKF | seqid_2176 |
| variant_2887 | RKKKFLKIPPPKFKKSALKF | seqid_2177 |
| variant_2888 | FKKKFLKIPPPKFKKSALKF | seqid_2178 |
| variant_2889 | KWKKFLKIPPPKFKKSALKF | seqid_2179 |
| variant_2890 | RWKKFLKIPPPKFKKSALKF | seqid_2180 |

| | | |
|---|---|---|
| variant_2891 | FWKKFLKIPPPKFKKSALKF | seqid_2181 |
| variant_2892 | KKKLLLKIPPPKFKKSALKF | seqid_2182 |
| variant_2893 | RKKLLLKIPPPKFKKSALKF | seqid_2183 |
| variant_2894 | FKKLLLKIPPPKFKKSALKF | seqid_2184 |
| variant_2895 | KWKLLLKIPPPKFKKSALKF | seqid_2185 |
| variant_2896 | RWKLLLKIPPPKFKKSALKF | seqid_2186 |
| variant_2897 | FWKLLLKIPPPKFKKSALKF | seqid_2187 |
| variant_2898 | KKKKLLKIPPPKFKKSALKF | seqid_2188 |
| variant_2899 | RKKKLLKIPPPKFKKSALKF | seqid_2189 |
| variant_2900 | FKKKLLKIPPPKFKKSALKF | seqid_2190 |
| variant_2901 | KWKKLLKIPPPKFKKSALKF | seqid_2191 |
| variant_2902 | RWKKLLKIPPPKFKKSALKF | seqid_2192 |
| variant_2903 | FWKKLLKIPPPKFKKSALKF | seqid_2193 |
| variant_2904 | KKKLFKKIPPPKFKKSALKF | seqid_2194 |
| variant_2905 | RKKLFKKIPPPKFKKSALKF | seqid_2195 |
| variant_2906 | FKKLFKKIPPPKFKKSALKF | seqid_2196 |
| variant_2907 | KWKLFKKIPPPKFKKSALKF | seqid_2197 |
| variant_2908 | RWKLFKKIPPPKFKKSALKF | seqid_2198 |
| variant_2909 | FWKLFKKIPPPKFKKSALKF | seqid_2199 |
| variant_2910 | KKKKFKKIPPPKFKKSALKF | seqid_2200 |
| variant_2911 | RKKKFKKIPPPKFKKSALKF | seqid_2201 |
| variant_2912 | FKKKFKKIPPPKFKKSALKF | seqid_2202 |
| variant_2913 | KWKKFKKIPPPKFKKSALKF | seqid_2203 |
| variant_2914 | RWKKFKKIPPPKFKKSALKF | seqid_2204 |
| variant_2915 | FWKKFKKIPPPKFKKSALKF | seqid_2205 |
| variant_2916 | KKKLLKKIPPPKFKKSALKF | seqid_2206 |
| variant_2917 | RKKLLKKIPPPKFKKSALKF | seqid_2207 |
| variant_2918 | FKKLLKKIPPPKFKKSALKF | seqid_2208 |
| variant_2919 | KWKLLKKIPPPKFKKSALKF | seqid_2209 |
| variant_2920 | RWKLLKKIPPPKFKKSALKF | seqid_2210 |
| variant_2921 | FWKLLKKIPPPKFKKSALKF | seqid_2211 |
| variant_2922 | KKKKLKKIPPPKFKKSALKF | seqid_2212 |
| variant_2923 | RKKKLKKIPPPKFKKSALKF | seqid_2213 |
| variant_2924 | FKKKLKKIPPPKFKKSALKF | seqid_2214 |
| variant_2925 | KWKKLKKIPPPKFKKSALKF | seqid_2215 |
| variant_2926 | RWKKLKKIPPPKFKKSALKF | seqid_2216 |
| variant_2927 | FWKKLKKIPPPKFKKSALKF | seqid_2217 |
| variant_2928 | KKKLFLKIPPPKFKKSALKF | seqid_2218 |
| variant_2929 | RKKLFLKIPPPKFKKSALKF | seqid_2219 |
| variant_2930 | FKKLFLKIPPPKFKKSALKF | seqid_2220 |
| variant_2931 | KWKLFLKIPPPKFKKSALKF | seqid_2221 |
| variant_2932 | RWKLFLKIPPPKFKKSALKF | seqid_2222 |
| variant_2933 | FWKLFLKIPPPKFKKSALKF | seqid_2223 |
| variant_2934 | KKKKFLKIPPPKFKKSALKF | seqid_2224 |
| variant_2935 | RKKKFLKIPPPKFKKSALKF | seqid_2225 |
| variant_2936 | FKKKFLKIPPPKFKKSALKF | seqid_2226 |
| variant_2937 | KWKKFLKIPPPKFKKSALKF | seqid_2227 |
| variant_2938 | RWKKFLKIPPPKFKKSALKF | seqid_2228 |
| variant_2939 | FWKKFLKIPPPKFKKSALKF | seqid_2229 |
| variant_2940 | KKKLLLKIPPKFKKSALKF | seqid_2230 |
| variant_2941 | RKKLLLKIPPKFKKSALKF | seqid_2231 |
| variant_2942 | FKKLLLKIPPKFKKSALKF | seqid_2232 |
| variant_2943 | KWKLLLKIPPKFKKSALKF | seqid_2233 |
| variant_2944 | RWKLLLKIPPKFKKSALKF | seqid_2234 |
| variant_2945 | FWKLLLKIPPKFKKSALKF | seqid_2235 |
| variant_2946 | KKKKLLKIPPKFKKSALKF | seqid_2236 |
| variant_2947 | RKKKLLKIPPKFKKSALKF | seqid_2237 |
| variant_2948 | FKKKLLKIPPKFKKSALKF | seqid_2238 |
| variant_2949 | KWKKLLKIPPKFKKSALKF | seqid_2239 |
| variant_2950 | RWKKLLKIPPKFKKSALKF | seqid_2240 |
| variant_2951 | FWKKLLKIPPKFKKSALKF | seqid_2241 |
| variant_2952 | KKKLFKKIPPKFKKSALKF | seqid_2242 |
| variant_2953 | RKKLFKKIPPKFKKSALKF | seqid_2243 |
| variant_2954 | FKKLFKKIPPKFKKSALKF | seqid_2244 |
| variant_2955 | KWKLFKKIPPKFKKSALKF | seqid_2245 |
| variant_2956 | RWKLFKKIPPKFKKSALKF | seqid_2246 |
| variant_2957 | FWKLFKKIPPKFKKSALKF | seqid_2247 |
| variant_2958 | KKKKFKKIPPKFKKSALKF | seqid_2248 |
| variant_2959 | RKKKFKKIPPKFKKSALKF | seqid_2249 |
| variant_2960 | FKKKFKKIPPKFKKSALKF | seqid_2250 |
| variant_2961 | KWKKFKKIPPKFKKSALKF | seqid_2251 |
| variant_2962 | RWKKFKKIPPKFKKSALKF | seqid_2252 |
| variant_2963 | FWKKFKKIPPKFKKSALKF | seqid_2253 |
| variant_2964 | KKKLLKKIPPKFKKSALKF | seqid_2254 |
| variant_2965 | RKKLLKKIPPKFKKSALKF | seqid_2255 |
| variant_2966 | FKKLLKKIPPKFKKSALKF | seqid_2256 |
| variant_2967 | KWKLLKKIPPKFKKSALKF | seqid_2257 |
| variant_2968 | RWKLLKKIPPKFKKSALKF | seqid_2258 |
| variant_2969 | FWKLLKKIPPKFKKSALKF | seqid_2259 |
| variant_2970 | KKKKLKKIPPKFKKSALKF | seqid_2260 |
| variant_2971 | RKKKLKKIPPKFKKSALKF | seqid_2261 |

| | | |
|---|---|---|
| variant_2972 | FKKKLKKIPPKFKKSALKF | seqid_2262 |
| variant_2973 | KWKKLKKIPPKFKKSALKF | seqid_2263 |
| variant_2974 | RWKKLKKIPPKFKKSALKF | seqid_2264 |
| variant_2975 | FWKKLKKIPPKFKKSALKF | seqid_2265 |
| variant_3024 | KKKLFLKIPKFKKSALKF | seqid_2266 |
| variant_3025 | RKKLFLKIPKFKKSALKF | seqid_2267 |
| variant_3026 | FKKLFLKIPKFKKSALKF | seqid_2268 |
| variant_3027 | KWKLFLKIPKFKKSALKF | seqid_2269 |
| variant_3028 | RWKLFLKIPKFKKSALKF | seqid_2270 |
| variant_3029 | FWKLFLKIPKFKKSALKF | seqid_2271 |
| variant_3030 | KKKKFLKIPKFKKSALKF | seqid_2272 |
| variant_3031 | RKKKFLKIPKFKKSALKF | seqid_2273 |
| variant_3032 | FKKKFLKIPKFKKSALKF | seqid_2274 |
| variant_3033 | KWKKFLKIPKFKKSALKF | seqid_2275 |
| variant_3034 | RWKKFLKIPKFKKSALKF | seqid_2276 |
| variant_3035 | FWKKFLKIPKFKKSALKF | seqid_2277 |
| variant_3036 | KKKLLLKIPKFKKSALKF | seqid_2278 |
| variant_3037 | RKKLLLKIPKFKKSALKF | seqid_2279 |
| variant_3038 | FKKLLLKIPKFKKSALKF | seqid_2280 |
| variant_3039 | KWKLLLKIPKFKKSALKF | seqid_2281 |
| variant_3040 | RWKLLLKIPKFKKSALKF | seqid_2282 |
| variant_3041 | FWKLLLKIPKFKKSALKF | seqid_2283 |
| variant_3042 | KKKKLLKIPKFKKSALKF | seqid_2284 |
| variant_3043 | RKKKLLKIPKFKKSALKF | seqid_2285 |
| variant_3044 | FKKKLLKIPKFKKSALKF | seqid_2286 |
| variant_3045 | KWKKLLKIPKFKKSALKF | seqid_2287 |
| variant_3046 | RWKKLLKIPKFKKSALKF | seqid_2288 |
| variant_3047 | FWKKLLKIPKFKKSALKF | seqid_2289 |
| variant_3048 | KKKLFKKIPKFKKSALKF | seqid_2290 |
| variant_3049 | RKKLFKKIPKFKKSALKF | seqid_2291 |
| variant_3050 | FKKLFKKIPKFKKSALKF | seqid_2292 |
| variant_3051 | KWKLFKKIPKFKKSALKF | seqid_2293 |
| variant_3052 | RWKLFKKIPKFKKSALKF | seqid_2294 |
| variant_3053 | FWKLFKKIPKFKKSALKF | seqid_2295 |
| variant_3054 | KKKKFKKIPKFKKSALKF | seqid_2296 |
| variant_3055 | RKKKFKKIPKFKKSALKF | seqid_2297 |
| variant_3056 | FKKKFKKIPKFKKSALKF | seqid_2298 |
| variant_3057 | KWKKFKKIPKFKKSALKF | seqid_2299 |
| variant_3058 | RWKKFKKIPKFKKSALKF | seqid_2300 |
| variant_3059 | FWKKFKKIPKFKKSALKF | seqid_2301 |
| variant_3060 | KKKLLKKIPKFKKSALKF | seqid_2302 |
| variant_3061 | RKKLLKKIPKFKKSALKF | seqid_2303 |
| variant_3062 | FKKLLKKIPKFKKSALKF | seqid_2304 |
| variant_3063 | KWKLLKKIPKFKKSALKF | seqid_2305 |
| variant_3064 | RWKLLKKIPKFKKSALKF | seqid_2306 |
| variant_3065 | FWKLLKKIPKFKKSALKF | seqid_2307 |
| variant_3066 | KKKKLKKIPKFKKSALKF | seqid_2308 |
| variant_3067 | RKKKLKKIPKFKKSALKF | seqid_2309 |
| variant_3068 | FKKKLKKIPKFKKSALKF | seqid_2310 |
| variant_3069 | KWKKLKKIPKFKKSALKF | seqid_2311 |
| variant_3070 | RWKKLKKIPKFKKSALKF | seqid_2312 |
| variant_3071 | FWKKLKKIPKFKKSALKF | seqid_2313 |
| variant_3072 | KKKLFLKIPPPKFLHAAKKF | seqid_2314 |
| variant_3073 | RKKLFLKIPPPKFLHAAKKF | seqid_2315 |
| variant_3074 | FKKLFLKIPPPKFLHAAKKF | seqid_2316 |
| variant_3075 | KWKLFLKIPPPKFLHAAKKF | seqid_2317 |
| variant_3076 | RWKLFLKIPPPKFLHAAKKF | seqid_2318 |
| variant_3077 | FWKLFLKIPPPKFLHAAKKF | seqid_2319 |
| variant_3078 | KKKKFLKIPPPKFLHAAKKF | seqid_2320 |
| variant_3079 | RKKKFLKIPPPKFLHAAKKF | seqid_2321 |
| variant_3080 | FKKKFLKIPPPKFLHAAKKF | seqid_2322 |
| variant_3081 | KWKKFLKIPPPKFLHAAKKF | seqid_2323 |
| variant_3082 | RWKKFLKIPPPKFLHAAKKF | seqid_2324 |
| variant_3083 | FWKKFLKIPPPKFLHAAKKF | seqid_2325 |
| variant_3084 | KKKLLLKIPPPKFLHAAKKF | seqid_2326 |
| variant_3085 | RKKLLLKIPPPKFLHAAKKF | seqid_2327 |
| variant_3086 | FKKLLLKIPPPKFLHAAKKF | seqid_2328 |
| variant_3087 | KWKLLLKIPPPKFLHAAKKF | seqid_2329 |
| variant_3088 | RWKLLLKIPPPKFLHAAKKF | seqid_2330 |
| variant_3089 | FWKLLLKIPPPKFLHAAKKF | seqid_2331 |
| variant_3090 | KKKKLLKIPPPKFLHAAKKF | seqid_2332 |
| variant_3091 | RKKKLLKIPPPKFLHAAKKF | seqid_2333 |
| variant_3092 | FKKKLLKIPPPKFLHAAKKF | seqid_2334 |
| variant_3093 | KWKKLLKIPPPKFLHAAKKF | seqid_2335 |
| variant_3094 | RWKKLLKIPPPKFLHAAKKF | seqid_2336 |
| variant_3095 | FWKKLLKIPPPKFLHAAKKF | seqid_2337 |
| variant_3096 | KKKLFKKIPPPKFLHAAKKF | seqid_2338 |
| variant_3097 | RKKLFKKIPPPKFLHAAKKF | seqid_2339 |
| variant_3098 | FKKLFKKIPPPKFLHAAKKF | seqid_2340 |
| variant_3099 | KWKLFKKIPPPKFLHAAKKF | seqid_2341 |
| variant_3100 | RWKLFKKIPPPKFLHAAKKF | seqid_2342 |

-continued

| | | |
|---|---|---|
| variant_3101 | FWKLFKKIPPPKFLHAAKKF | seqid_2343 |
| variant_3102 | KKKKFKKIPPPKFLHAAKKF | seqid_2344 |
| variant_3103 | RKKKFKKIPPPKFLHAAKKF | seqid_2345 |
| variant_3104 | FKKKFKKIPPPKFLHAAKKF | seqid_2346 |
| variant_3105 | KWKKFKKIPPPKFLHAAKKF | seqid_2347 |
| variant_3106 | RWKKFKKIPPPKFLHAAKKF | seqid_2348 |
| variant_3107 | FWKKFKKIPPPKFLHAAKKF | seqid_2349 |
| variant_3108 | KKKLLKKIPPPKFLHAAKKF | seqid_2350 |
| variant_3109 | RKKLLKKIPPPKFLHAAKKF | seqid_2351 |
| variant_3110 | FKKLLKKIPPPKFLHAAKKF | seqid_2352 |
| variant_3111 | KWKLLKKIPPPKFLHAAKKF | seqid_2353 |
| variant_3112 | RWKLLKKIPPPKFLHAAKKF | seqid_2354 |
| variant_3113 | FWKLLKKIPPPKFLHAAKKF | seqid_2355 |
| variant_3114 | KKKKLKKIPPPKFLHAAKKF | seqid_2356 |
| variant_3115 | RKKKLKKIPPPKFLHAAKKF | seqid_2357 |
| variant_3116 | FKKKLKKIPPPKFLHAAKKF | seqid_2358 |
| variant_3117 | KWKKLKKIPPPKFLHAAKKF | seqid_2359 |
| variant_3118 | RWKKLKKIPPPKFLHAAKKF | seqid_2360 |
| variant_3119 | FWKKLKKIPPPKFLHAAKKF | seqid_2361 |
| variant_3120 | KKKLFLKIPPKFLHAAKKF | seqid_2362 |
| variant_3121 | RKKLFLKIPPKFLHAAKKF | seqid_2363 |
| variant_3122 | FKKLFLKIPPKFLHAAKKF | seqid_2364 |
| variant_3123 | KWKLFLKIPPKFLHAAKKF | seqid_2365 |
| variant_3124 | RWKLFLKIPPKFLHAAKKF | seqid_2366 |
| variant_3125 | FWKLFLKIPPKFLHAAKKF | seqid_2367 |
| variant_3126 | KKKKFLKIPPKFLHAAKKF | seqid_2368 |
| variant_3127 | RKKKFLKIPPKFLHAAKKF | seqid_2369 |
| variant_3128 | FKKKFLKIPPKFLHAAKKF | seqid_2370 |
| variant_3129 | KWKKFLKIPPKFLHAAKKF | seqid_2371 |
| variant_3130 | RWKKFLKIPPKFLHAAKKF | seqid_2372 |
| variant_3131 | FWKKFLKIPPKFLHAAKKF | seqid_2373 |
| variant_3132 | KKKLLLKIPPKFLHAAKKF | seqid_2374 |
| variant_3133 | RKKLLLKIPPKFLHAAKKF | seqid_2375 |
| variant_3134 | FKKLLLKIPPKFLHAAKKF | seqid_2376 |
| variant_3135 | KWKLLLKIPPKFLHAAKKF | seqid_2377 |
| variant_3136 | RWKLLLKIPPKFLHAAKKF | seqid_2378 |
| variant_3137 | FWKLLLKIPPKFLHAAKKF | seqid_2379 |
| variant_3138 | KKKKLLKIPPKFLHAAKKF | seqid_2380 |
| variant_3139 | RKKKLLKIPPKFLHAAKKF | seqid_2381 |
| variant_3140 | FKKKLLKIPPKFLHAAKKF | seqid_2382 |
| variant_3141 | KWKKLLKIPPKFLHAAKKF | seqid_2383 |
| variant_3142 | RWKKLLKIPPKFLHAAKKF | seqid_2384 |
| variant_3143 | FWKKLLKIPPKFLHAAKKF | seqid_2385 |
| variant_3144 | KKKLFKKIPPKFLHAAKKF | seqid_2386 |
| variant_3145 | RKKLFKKIPPKFLHAAKKF | seqid_2387 |
| variant_3146 | FKKLFKKIPPKFLHAAKKF | seqid_2388 |
| variant_3147 | KWKLFKKIPPKFLHAAKKF | seqid_2389 |
| variant_3148 | RWKLFKKIPPKFLHAAKKF | seqid_2390 |
| variant_3149 | FWKLFKKIPPKFLHAAKKF | seqid_2391 |
| variant_3150 | KKKKFKKIPPKFLHAAKKF | seqid_2392 |
| variant_3151 | RKKKFKKIPPKFLHAAKKF | seqid_2393 |
| variant_3152 | FKKKFKKIPPKFLHAAKKF | seqid_2394 |
| variant_3153 | KWKKFKKIPPKFLHAAKKF | seqid_2395 |
| variant_3154 | RWKKFKKIPPKFLHAAKKF | seqid_2396 |
| variant_3155 | FWKKFKKIPPKFLHAAKKF | seqid_2397 |
| variant_3156 | KKKLLKKIPPKFLHAAKKF | seqid_2398 |
| variant_3157 | RKKLLKKIPPKFLHAAKKF | seqid_2399 |
| variant_3158 | FKKLLKKIPPKFLHAAKKF | seqid_2400 |
| variant_3159 | KWKLLKKIPPKFLHAAKKF | seqid_2401 |
| variant_3160 | RWKLLKKIPPKFLHAAKKF | seqid_2402 |
| variant_3161 | FWKLLKKIPPKFLHAAKKF | seqid_2403 |
| variant_3162 | KKKKLKKIPPKFLHAAKKF | seqid_2404 |
| variant_3163 | RKKKLKKIPPKFLHAAKKF | seqid_2405 |
| variant_3164 | FKKKLKKIPPKFLHAAKKF | seqid_2406 |
| variant_3165 | KWKKLKKIPPKFLHAAKKF | seqid_2407 |
| variant_3166 | RWKKLKKIPPKFLHAAKKF | seqid_2408 |
| variant_3167 | FWKKLKKIPPKFLHAAKKF | seqid_2409 |
| variant_3216 | KKKLFLKIPKFLHAAKKF | seqid_2410 |
| variant_3217 | RKKLFLKIPKFLHAAKKF | seqid_2411 |
| variant_3218 | FKKLFLKIPKFLHAAKKF | seqid_2412 |
| variant_3219 | KWKLFLKIPKFLHAAKKF | seqid_2413 |
| variant_3220 | RWKLFLKIPKFLHAAKKF | seqid_2414 |
| variant_3221 | FWKLFLKIPKFLHAAKKF | seqid_2415 |
| variant_3222 | KKKKFLKIPKFLHAAKKF | seqid_2416 |
| variant_3223 | RKKKFLKIPKFLHAAKKF | seqid_2417 |
| variant_3224 | FKKKFLKIPKFLHAAKKF | seqid_2418 |
| variant_3225 | KWKKFLKIPKFLHAAKKF | seqid_8 |
| variant_3226 | RWKKFLKIPKFLHAAKKF | seqid_2419 |
| variant_3227 | FWKKFLKIPKFLHAAKKF | seqid_2420 |
| variant_3228 | KKKLLLKIPKFLHAAKKF | seqid_2421 |
| variant_3229 | RKKLLLKIPKFLHAAKKF | seqid_2422 |

| | | |
|---|---|---|
| variant_3230 | FKKLLLKIPKFLHAAKKF | seqid_2423 |
| variant_3231 | KWKLLLKIPKFLHAAKKF | seqid_2424 |
| variant_3232 | RWKLLLKIPKFLHAAKKF | seqid_2425 |
| variant_3233 | FWKLLLKIPKFLHAAKKF | seqid_2426 |
| variant_3234 | KKKKLLKIPKFLHAAKKF | seqid_2427 |
| variant_3235 | RKKKLLKIPKFLHAAKKF | seqid_2428 |
| variant_3236 | FKKKLLKIPKFLHAAKKF | seqid_2429 |
| variant_3237 | KWKKLLKIPKFLHAAKKF | seqid_9 |
| variant_3238 | RWKKLLKIPKFLHAAKKF | seqid_2430 |
| variant_3239 | FWKKLLKIPKFLHAAKKF | seqid_2431 |
| variant_3240 | KKKLFKKIPKFLHAAKKF | seqid_2432 |
| variant_3241 | RKKLFKKIPKFLHAAKKF | seqid_2433 |
| variant_3242 | FKKLFKKIPKFLHAAKKF | seqid_5 |
| variant_3243 | KWKLFKKIPKFLHAAKKF | seqid_7 |
| variant_3244 | RWKLFKKIPKFLHAAKKF | seqid_2434 |
| variant_3245 | FWKLFKKIPKFLHAAKKF | seqid_2435 |
| variant_3246 | KKKKFKKIPKFLHAAKKF | seqid_2436 |
| variant_3247 | RKKKFKKIPKFLHAAKKF | seqid_2437 |
| variant_3248 | FKKKFKKIPKFLHAAKKF | seqid_2438 |
| variant_3249 | KWKKFKKIPKFLHAAKKF | seqid_2439 |
| variant_3250 | RWKKFKKIPKFLHAAKKF | seqid_2440 |
| variant_3251 | FWKKFKKIPKFLHAAKKF | seqid_2441 |
| variant_3252 | KKKLLKKIPKFLHAAKKF | seqid_2442 |
| variant_3253 | RKKLLKKIPKFLHAAKKF | seqid_2443 |
| variant_3254 | FKKLLKKIPKFLHAAKKF | seqid_2444 |
| variant_3255 | KWKLLKKIPKFLHAAKKF | seqid_2445 |
| variant_3256 | RWKLLKKIPKFLHAAKKF | seqid_2446 |
| variant_3257 | FWKLLKKIPKFLHAAKKF | seqid_2447 |
| variant_3258 | KKKKLKKIPKFLHAAKKF | seqid_2448 |
| variant_3259 | RKKKLKKIPKFLHAAKKF | seqid_2449 |
| variant_3260 | FKKKLKKIPKFLHAAKKF | seqid_2450 |
| variant_3261 | KWKKLKKIPKFLHAAKKF | seqid_2451 |
| variant_3262 | RWKKLKKIPKFLHAAKKF | seqid_2452 |
| variant_3263 | FWKKLKKIPKFLHAAKKF | seqid_2453 |
| variant_3264 | KKKLFLKIPPPKFKHAAKKF | seqid_2454 |
| variant_3265 | RKKLFLKIPPPKFKHAAKKF | seqid_2455 |
| variant_3266 | FKKLFLKIPPPKFKHAAKKF | seqid_2456 |
| variant_3267 | KWKLFLKIPPPKFKHAAKKF | seqid_2457 |
| variant_3268 | RWKLFLKIPPPKFKHAAKKF | seqid_2458 |
| variant_3269 | FWKLFLKIPPPKFKHAAKKF | seqid_2459 |
| variant_3270 | KKKKFLKIPPPKFKHAAKKF | seqid_2460 |
| variant_3271 | RKKKFLKIPPPKFKHAAKKF | seqid_2461 |
| variant_3272 | FKKKFLKIPPPKFKHAAKKF | seqid_2462 |
| variant_3273 | KWKKFLKIPPPKFKHAAKKF | seqid_2463 |
| variant_3274 | RWKKFLKIPPPKFKHAAKKF | seqid_2464 |
| variant_3275 | FWKKFLKIPPPKFKHAAKKF | seqid_2465 |
| variant_3276 | KKKLLLKIPPPKFKHAAKKF | seqid_2466 |
| variant_3277 | RKKLLLKIPPPKFKHAAKKF | seqid_2467 |
| variant_3278 | FKKLLLKIPPPKFKHAAKKF | seqid_2468 |
| variant_3279 | KWKLLLKIPPPKFKHAAKKF | seqid_2469 |
| variant_3280 | RWKLLLKIPPPKFKHAAKKF | seqid_2470 |
| variant_3281 | FWKLLLKIPPPKFKHAAKKF | seqid_2471 |
| variant_3282 | KKKKLLKIPPPKFKHAAKKF | seqid_2472 |
| variant_3283 | RKKKLLKIPPPKFKHAAKKF | seqid_2473 |
| variant_3284 | FKKKLLKIPPPKFKHAAKKF | seqid_2474 |
| variant_3285 | KWKKLLKIPPPKFKHAAKKF | seqid_2475 |
| variant_3286 | RWKKLLKIPPPKFKHAAKKF | seqid_2476 |
| variant_3287 | FWKKLLKIPPPKFKHAAKKF | seqid_2477 |
| variant_3288 | KKKLFKKIPPPKFKHAAKKF | seqid_2478 |
| variant_3289 | RKKLFKKIPPPKFKHAAKKF | seqid_2479 |
| variant_3290 | FKKLFKKIPPPKFKHAAKKF | seqid_2480 |
| variant_3291 | KWKLFKKIPPPKFKHAAKKF | seqid_2481 |
| variant_3292 | RWKLFKKIPPPKFKHAAKKF | seqid_2482 |
| variant_3293 | FWKLFKKIPPPKFKHAAKKF | seqid_2483 |
| variant_3294 | KKKKFKKIPPPKFKHAAKKF | seqid_2484 |
| variant_3295 | RKKKFKKIPPPKFKHAAKKF | seqid_2485 |
| variant_3296 | FKKKFKKIPPPKFKHAAKKF | seqid_2486 |
| variant_3297 | KWKKFKKIPPPKFKHAAKKF | seqid_2487 |
| variant_3298 | RWKKFKKIPPPKFKHAAKKF | seqid_2488 |
| variant_3299 | FWKKFKKIPPPKFKHAAKKF | seqid_2489 |
| variant_3300 | KKKLLKKIPPPKFKHAAKKF | seqid_2490 |
| variant_3301 | RKKLLKKIPPPKFKHAAKKF | seqid_2491 |
| variant_3302 | FKKLLKKIPPPKFKHAAKKF | seqid_2492 |
| variant_3303 | KWKLLKKIPPPKFKHAAKKF | seqid_2493 |
| variant_3304 | RWKLLKKIPPPKFKHAAKKF | seqid_2494 |
| variant_3305 | FWKLLKKIPPPKFKHAAKKF | seqid_2495 |
| variant_3306 | KKKKLKKIPPPKFKHAAKKF | seqid_2496 |
| variant_3307 | RKKKLKKIPPPKFKHAAKKF | seqid_2497 |
| variant_3308 | FKKKLKKIPPPKFKHAAKKF | seqid_2498 |
| variant_3309 | KWKKLKKIPPPKFKHAAKKF | seqid_2499 |
| variant_3310 | RWKKLKKIPPPKFKHAAKKF | seqid_2500 |

| variant_3311 | FWKKLKKIPPPKFKHAAKKF | seqid_2501 |
| variant_3312 | KKKLFLKIPPKFKHAAKKF | seqid_2502 |
| variant_3313 | RKKLFLKIPPKFKHAAKKF | seqid_2503 |
| variant_3314 | FKKLFLKIPPKFKHAAKKF | seqid_2504 |
| variant_3315 | KWKLFLKIPPKFKHAAKKF | seqid_2505 |
| variant_3316 | RWKLFLKIPPKFKHAAKKF | seqid_2506 |
| variant_3317 | FWKLFLKIPPKFKHAAKKF | seqid_2507 |
| variant_3318 | KKKKFLKIPPKFKHAAKKF | seqid_2508 |
| variant_3319 | RKKKFLKIPPKFKHAAKKF | seqid_2509 |
| variant_3320 | FKKKFLKIPPKFKHAAKKF | seqid_2510 |
| variant_3321 | KWKKFLKIPPKFKHAAKKF | seqid_2511 |
| variant_3322 | RWKKFLKIPPKFKHAAKKF | seqid_2512 |
| variant_3323 | FWKKFLKIPPKFKHAAKKF | seqid_2513 |
| variant_3324 | KKKLLLKIPPKFKHAAKKF | seqid_2514 |
| variant_3325 | RKKLLLKIPPKFKHAAKKF | seqid_2515 |
| variant_3326 | FKKLLLKIPPKFKHAAKKF | seqid_2516 |
| variant_3327 | KWKLLLKIPPKFKHAAKKF | seqid_2517 |
| variant_3328 | RWKLLLKIPPKFKHAAKKF | seqid_2518 |
| variant_3329 | FWKLLLKIPPKFKHAAKKF | seqid_2519 |
| variant_3330 | KKKKLLKIPPKFKHAAKKF | seqid_2520 |
| variant_3331 | RKKKLLKIPPKFKHAAKKF | seqid_2521 |
| variant_3332 | FKKKLLKIPPKFKHAAKKF | seqid_2522 |
| variant_3333 | KWKKLLKIPPKFKHAAKKF | seqid_2523 |
| variant_3334 | RWKKLLKIPPKFKHAAKKF | seqid_2524 |
| variant_3335 | FWKKLLKIPPKFKHAAKKF | seqid_2525 |
| variant_3336 | KKKLFKKIPPKFKHAAKKF | seqid_2526 |
| variant_3337 | RKKLFKKIPPKFKHAAKKF | seqid_2527 |
| variant_3338 | FKKLFKKIPPKFKHAAKKF | seqid_2528 |
| variant_3339 | KWKLFKKIPPKFKHAAKKF | seqid_2529 |
| variant_3340 | RWKLFKKIPPKFKHAAKKF | seqid_2530 |
| variant_3341 | FWKLFKKIPPKFKHAAKKF | seqid_2531 |
| variant_3342 | KKKKFKKIPPKFKHAAKKF | seqid_2532 |
| variant_3343 | RKKKFKKIPPKFKHAAKKF | seqid_2533 |
| variant_3344 | FKKKFKKIPPKFKHAAKKF | seqid_2534 |
| variant_3345 | KWKKFKKIPPKFKHAAKKF | seqid_2535 |
| variant_3346 | RWKKFKKIPPKFKHAAKKF | seqid_2536 |
| variant_3347 | FWKKFKKIPPKFKHAAKKF | seqid_2537 |
| variant_3348 | KKKLLKKIPPKFKHAAKKF | seqid_2538 |
| variant_3349 | RKKLLKKIPPKFKHAAKKF | seqid_2539 |
| variant_3350 | FKKLLKKIPPKFKHAAKKF | seqid_2540 |
| variant_3351 | KWKLLKKIPPKFKHAAKKF | seqid_2541 |
| variant_3352 | RWKLLKKIPPKFKHAAKKF | seqid_2542 |
| variant_3353 | FWKLLKKIPPKFKHAAKKF | seqid_2543 |
| variant_3354 | KKKKLKKIPPKFKHAAKKF | seqid_2544 |
| variant_3355 | RKKKLKKIPPKFKHAAKKF | seqid_2545 |
| variant_3356 | FKKKLKKIPPKFKHAAKKF | seqid_2546 |
| variant_3357 | KWKKLKKIPPKFKHAAKKF | seqid_2547 |
| variant_3358 | RWKKLKKIPPKFKHAAKKF | seqid_2548 |
| variant_3359 | FWKKLKKIPPKFKHAAKKF | seqid_2549 |
| variant_3408 | KKKLFLKIPKFKHAAKKF | seqid_2550 |
| variant_3409 | RKKLFLKIPKFKHAAKKF | seqid_2551 |
| variant_3410 | FKKLFLKIPKFKHAAKKF | seqid_2552 |
| variant_3411 | KWKLFLKIPKFKHAAKKF | seqid_2553 |
| variant_3412 | RWKLFLKIPKFKHAAKKF | seqid_2554 |
| variant_3413 | FWKLFLKIPKFKHAAKKF | seqid_2555 |
| variant_3414 | KKKKFLKIPKFKHAAKKF | seqid_2556 |
| variant_3415 | RKKKFLKIPKFKHAAKKF | seqid_2557 |
| variant_3416 | FKKKFLKIPKFKHAAKKF | seqid_2558 |
| variant_3417 | KWKKFLKIPKFKHAAKKF | seqid_2559 |
| variant_3418 | RWKKFLKIPKFKHAAKKF | seqid_2560 |
| variant_3419 | FWKKFLKIPKFKHAAKKF | seqid_2561 |
| variant_3420 | KKKLLLKIPKFKHAAKKF | seqid_2562 |
| variant_3421 | RKKLLLKIPKFKHAAKKF | seqid_2563 |
| variant_3422 | FKKLLLKIPKFKHAAKKF | seqid_2564 |
| variant_3423 | KWKLLLKIPKFKHAAKKF | seqid_2565 |
| variant_3424 | RWKLLLKIPKFKHAAKKF | seqid_2566 |
| variant_3425 | FWKLLLKIPKFKHAAKKF | seqid_2567 |
| variant_3426 | KKKKLLKIPKFKHAAKKF | seqid_2568 |
| variant_3427 | RKKKLLKIPKFKHAAKKF | seqid_2569 |
| variant_3428 | FKKKLLKIPKFKHAAKKF | seqid_2570 |
| variant_3429 | KWKKLLKIPKFKHAAKKF | seqid_2571 |
| variant_3430 | RWKKLLKIPKFKHAAKKF | seqid_2572 |
| variant_3431 | FWKKLLKIPKFKHAAKKF | seqid_2573 |
| variant_3432 | KKKLFKKIPKFKHAAKKF | seqid_2574 |
| variant_3433 | RKKLFKKIPKFKHAAKKF | seqid_2575 |
| variant_3434 | FKKLFKKIPKFKHAAKKF | seqid_2576 |
| variant_3435 | KWKLFKKIPKFKHAAKKF | seqid_2577 |
| variant_3436 | RWKLFKKIPKFKHAAKKF | seqid_2578 |
| variant_3437 | FWKLFKKIPKFKHAAKKF | seqid_2579 |
| variant_3438 | KKKKFKKIPKFKHAAKKF | seqid_2580 |
| variant_3439 | RKKKFKKIPKFKHAAKKF | seqid_2581 |

| | | |
|---|---|---|
| variant_3440 | FKKKFKKIPKFKHAAKKF | seqid_2582 |
| variant_3441 | KWKKFKKIPKFKHAAKKF | seqid_2583 |
| variant_3442 | RWKKFKKIPKFKHAAKKF | seqid_2584 |
| variant_3443 | FWKKFKKIPKFKHAAKKF | seqid_2585 |
| variant_3444 | KKKLLKKIPKFKHAAKKF | seqid_2586 |
| variant_3445 | RKKLLKKIPKFKHAAKKF | seqid_2587 |
| variant_3446 | FKKLLKKIPKFKHAAKKF | seqid_2588 |
| variant_3447 | KWKLLKKIPKFKHAAKKF | seqid_2589 |
| variant_3448 | RWKLLKKIPKFKHAAKKF | seqid_2590 |
| variant_3449 | FWKLLKKIPKFKHAAKKF | seqid_2591 |
| variant_3450 | KKKKLKKIPKFKHAAKKF | seqid_2592 |
| variant_3451 | RKKKLKKIPKFKHAAKKF | seqid_2593 |
| variant_3452 | FKKKLKKIPKFKHAAKKF | seqid_2594 |
| variant_3453 | KWKKLKKIPKFKHAAKKF | seqid_2595 |
| variant_3454 | RWKKLKKIPKFKHAAKKF | seqid_2596 |
| variant_3455 | FWKKLKKIPKFKHAAKKF | seqid_2597 |
| variant_3456 | KKKLFLKIPPPKFLKAAKKF | seqid_2598 |
| variant_3457 | RKKLFLKIPPPKFLKAAKKF | seqid_2599 |
| variant_3458 | FKKLFLKIPPPKFLKAAKKF | seqid_2600 |
| variant_3459 | KWKLFLKIPPPKFLKAAKKF | seqid_2601 |
| variant_3460 | RWKLFLKIPPPKFLKAAKKF | seqid_2602 |
| variant_3461 | FWKLFLKIPPPKFLKAAKKF | seqid_2603 |
| variant_3462 | KKKKFLKIPPPKFLKAAKKF | seqid_2604 |
| variant_3463 | RKKKFLKIPPPKFLKAAKKF | seqid_2605 |
| variant_3464 | FKKKFLKIPPPKFLKAAKKF | seqid_2606 |
| variant_3465 | KWKKFLKIPPPKFLKAAKKF | seqid_2607 |
| variant_3466 | RWKKFLKIPPPKFLKAAKKF | seqid_2608 |
| variant_3467 | FWKKFLKIPPPKFLKAAKKF | seqid_2609 |
| variant_3468 | KKKLLLKIPPPKFLKAAKKF | seqid_2610 |
| variant_3469 | RKKLLLKIPPPKFLKAAKKF | seqid_2611 |
| variant_3470 | FKKLLLKIPPPKFLKAAKKF | seqid_2612 |
| variant_3471 | KWKLLLKIPPPKFLKAAKKF | seqid_2613 |
| variant_3472 | RWKLLLKIPPPKFLKAAKKF | seqid_2614 |
| variant_3473 | FWKLLLKIPPPKFLKAAKKF | seqid_2615 |
| variant_3474 | KKKKLLKIPPPKFLKAAKKF | seqid_2616 |
| variant_3475 | RKKKLLKIPPPKFLKAAKKF | seqid_2617 |
| variant_3476 | FKKKLLKIPPPKFLKAAKKF | seqid_2618 |
| variant_3477 | KWKKLLKIPPPKFLKAAKKF | seqid_2619 |
| variant_3478 | RWKKLLKIPPPKFLKAAKKF | seqid_2620 |
| variant_3479 | FWKKLLKIPPPKFLKAAKKF | seqid_2621 |
| variant_3480 | KKKLFKKIPPPKFLKAAKKF | seqid_2622 |
| variant_3481 | RKKLFKKIPPPKFLKAAKKF | seqid_2623 |
| variant_3482 | FKKLFKKIPPPKFLKAAKKF | seqid_2624 |
| variant_3483 | KWKLFKKIPPPKFLKAAKKF | seqid_2625 |
| variant_3484 | RWKLFKKIPPPKFLKAAKKF | seqid_2626 |
| variant_3485 | FWKLFKKIPPPKFLKAAKKF | seqid_2627 |
| variant_3486 | KKKKFKKIPPPKFLKAAKKF | seqid_2628 |
| variant_3487 | RKKKFKKIPPPKFLKAAKKF | seqid_2629 |
| variant_3488 | FKKKFKKIPPPKFLKAAKKF | seqid_2630 |
| variant_3489 | KWKKFKKIPPPKFLKAAKKF | seqid_2631 |
| variant_3490 | RWKKFKKIPPPKFLKAAKKF | seqid_2632 |
| variant_3491 | FWKKFKKIPPPKFLKAAKKF | seqid_2633 |
| variant_3492 | KKKLLKKIPPPKFLKAAKKF | seqid_2634 |
| variant_3493 | RKKLLKKIPPPKFLKAAKKF | seqid_2635 |
| variant_3494 | FKKLLKKIPPPKFLKAAKKF | seqid_2636 |
| variant_3495 | KWKLLKKIPPPKFLKAAKKF | seqid_2637 |
| variant_3496 | RWKLLKKIPPPKFLKAAKKF | seqid_2638 |
| variant_3497 | FWKLLKKIPPPKFLKAAKKF | seqid_2639 |
| variant_3498 | KKKKLKKIPPPKFLKAAKKF | seqid_2640 |
| variant_3499 | RKKKLKKIPPPKFLKAAKKF | seqid_2641 |
| variant_3500 | FKKKLKKIPPPKFLKAAKKF | seqid_2642 |
| variant_3501 | KWKKLKKIPPPKFLKAAKKF | seqid_2643 |
| variant_3502 | RWKKLKKIPPPKFLKAAKKF | seqid_2644 |
| variant_3503 | FWKKLKKIPPPKFLKAAKKF | seqid_2645 |
| variant_3504 | KKKLFLKIPPKFLKAAKKF | seqid_2646 |
| variant_3505 | RKKLFLKIPPKFLKAAKKF | seqid_2647 |
| variant_3506 | FKKLFLKIPPKFLKAAKKF | seqid_2648 |
| variant_3507 | KWKLFLKIPPKFLKAAKKF | seqid_2649 |
| variant_3508 | RWKLFLKIPPKFLKAAKKF | seqid_2650 |
| variant_3509 | FWKLFLKIPPKFLKAAKKF | seqid_2651 |
| variant_3510 | KKKKFLKIPPKFLKAAKKF | seqid_2652 |
| variant_3511 | RKKKFLKIPPKFLKAAKKF | seqid_2653 |
| variant_3512 | FKKKFLKIPPKFLKAAKKF | seqid_2654 |
| variant_3513 | KWKKFLKIPPKFLKAAKKF | seqid_2655 |
| variant_3514 | RWKKFLKIPPKFLKAAKKF | seqid_2656 |
| variant_3515 | FWKKFLKIPPKFLKAAKKF | seqid_2657 |
| variant_3516 | KKKLLLKIPPKFLKAAKKF | seqid_2658 |
| variant_3517 | RKKLLLKIPPKFLKAAKKF | seqid_2659 |
| variant_3518 | FKKLLLKIPPKFLKAAKKF | seqid_2660 |
| variant_3519 | KWKLLLKIPPKFLKAAKKF | seqid_2661 |
| variant_3520 | RWKLLLKIPPKFLKAAKKF | seqid_2662 |

| | | |
|---|---|---|
| variant_3521 | FWKLLLKIPPKFLKAAKKF | seqid_2663 |
| variant_3522 | KKKKLLKIPPKFLKAAKKF | seqid_2664 |
| variant_3523 | RKKKLLKIPPKFLKAAKKF | seqid_2665 |
| variant_3524 | FKKKLLKIPPKFLKAAKKF | seqid_2666 |
| variant_3525 | KWKKLLKIPPKFLKAAKKF | seqid_2667 |
| variant_3526 | RWKKLLKIPPKFLKAAKKF | seqid_2668 |
| variant_3527 | FWKKLLKIPPKFLKAAKKF | seqid_2669 |
| variant_3528 | KKKLFKKIPPKFLKAAKKF | seqid_2670 |
| variant_3529 | RKKLFKKIPPKFLKAAKKF | seqid_2671 |
| variant_3530 | FKKLFKKIPPKFLKAAKKF | seqid_2672 |
| variant_3531 | KWKLFKKIPPKFLKAAKKF | seqid_2673 |
| variant_3532 | RWKLFKKIPPKFLKAAKKF | seqid_2674 |
| variant_3533 | FWKLFKKIPPKFLKAAKKF | seqid_2675 |
| variant_3534 | KKKKFKKIPPKFLKAAKKF | seqid_2676 |
| variant_3535 | RKKKFKKIPPKFLKAAKKF | seqid_2677 |
| variant_3536 | FKKKFKKIPPKFLKAAKKF | seqid_2678 |
| variant_3537 | KWKKFKKIPPKFLKAAKKF | seqid_2679 |
| variant_3538 | RWKKFKKIPPKFLKAAKKF | seqid_2680 |
| variant_3539 | FWKKFKKIPPKFLKAAKKF | seqid_2681 |
| variant_3540 | KKKLLKKIPPKFLKAAKKF | seqid_2682 |
| variant_3541 | RKKLLKKIPPKFLKAAKKF | seqid_2683 |
| variant_3542 | FKKLLKKIPPKFLKAAKKF | seqid_2684 |
| variant_3543 | KWKLLKKIPPKFLKAAKKF | seqid_2685 |
| variant_3544 | RWKLLKKIPPKFLKAAKKF | seqid_2686 |
| variant_3545 | FWKLLKKIPPKFLKAAKKF | seqid_2687 |
| variant_3546 | KKKKLKKIPPKFLKAAKKF | seqid_2688 |
| variant_3547 | RKKKLKKIPPKFLKAAKKF | seqid_2689 |
| variant_3548 | FKKKLKKIPPKFLKAAKKF | seqid_2690 |
| variant_3549 | KWKKLKKIPPKFLKAAKKF | seqid_2691 |
| variant_3550 | RWKKLKKIPPKFLKAAKKF | seqid_2692 |
| variant_3551 | FWKKLKKIPPKFLKAAKKF | seqid_2693 |
| variant_3600 | KKKLFLKIPKFLKAAKKF | seqid_2694 |
| variant_3601 | RKKLFLKIPKFLKAAKKF | seqid_2695 |
| variant_3602 | FKKLFLKIPKFLKAAKKF | seqid_2696 |
| variant_3603 | KWKLFLKIPKFLKAAKKF | seqid_2697 |
| variant_3604 | RWKLFLKIPKFLKAAKKF | seqid_2698 |
| variant_3605 | FWKLFLKIPKFLKAAKKF | seqid_2699 |
| variant_3606 | KKKKFLKIPKFLKAAKKF | seqid_2700 |
| variant_3607 | RKKKFLKIPKFLKAAKKF | seqid_2701 |
| variant_3608 | FKKKFLKIPKFLKAAKKF | seqid_2702 |
| variant_3609 | KWKKFLKIPKFLKAAKKF | seqid_2703 |
| variant_3610 | RWKKFLKIPKFLKAAKKF | seqid_2704 |
| variant_3611 | FWKKFLKIPKFLKAAKKF | seqid_2705 |
| variant_3612 | KKKLLLKIPKFLKAAKKF | seqid_2706 |
| variant_3613 | RKKLLLKIPKFLKAAKKF | seqid_2707 |
| variant_3614 | FKKLLLKIPKFLKAAKKF | seqid_2708 |
| variant_3615 | KWKLLLKIPKFLKAAKKF | seqid_2709 |
| variant_3616 | RWKLLLKIPKFLKAAKKF | seqid_2710 |
| variant_3617 | FWKLLLKIPKFLKAAKKF | seqid_2711 |
| variant_3618 | KKKKLLKIPKFLKAAKKF | seqid_2712 |
| variant_3619 | RKKKLLKIPKFLKAAKKF | seqid_2713 |
| variant_3620 | FKKKLLKIPKFLKAAKKF | seqid_2714 |
| variant_3621 | KWKKLLKIPKFLKAAKKF | seqid_2715 |
| variant_3622 | RWKKLLKIPKFLKAAKKF | seqid_2716 |
| variant_3623 | FWKKLLKIPKFLKAAKKF | seqid_2717 |
| variant_3624 | KKKLFKKIPKFLKAAKKF | seqid_2718 |
| variant_3625 | RKKLFKKIPKFLKAAKKF | seqid_2719 |
| variant_3626 | FKKLFKKIPKFLKAAKKF | seqid_2720 |
| variant_3627 | KWKLFKKIPKFLKAAKKF | seqid_2721 |
| variant_3628 | RWKLFKKIPKFLKAAKKF | seqid_2722 |
| variant_3629 | FWKLFKKIPKFLKAAKKF | seqid_2723 |
| variant_3630 | KKKKFKKIPKFLKAAKKF | seqid_2724 |
| variant_3631 | RKKKFKKIPKFLKAAKKF | seqid_2725 |
| variant_3632 | FKKKFKKIPKFLKAAKKF | seqid_2726 |
| variant_3633 | KWKKFKKIPKFLKAAKKF | seqid_2727 |
| variant_3634 | RWKKFKKIPKFLKAAKKF | seqid_2728 |
| variant_3635 | FWKKFKKIPKFLKAAKKF | seqid_2729 |
| variant_3636 | KKKLLKKIPKFLKAAKKF | seqid_2730 |
| variant_3637 | RKKLLKKIPKFLKAAKKF | seqid_2731 |
| variant_3638 | FKKLLKKIPKFLKAAKKF | seqid_2732 |
| variant_3639 | KWKLLKKIPKFLKAAKKF | seqid_2733 |
| variant_3640 | RWKLLKKIPKFLKAAKKF | seqid_2734 |
| variant_3641 | FWKLLKKIPKFLKAAKKF | seqid_2735 |
| variant_3642 | KKKKLKKIPKFLKAAKKF | seqid_2736 |
| variant_3643 | RKKKLKKIPKFLKAAKKF | seqid_2737 |
| variant_3644 | FKKKLKKIPKFLKAAKKF | seqid_2738 |
| variant_3645 | KWKKLKKIPKFLKAAKKF | seqid_2739 |
| variant_3646 | RWKKLKKIPKFLKAAKKF | seqid_2740 |
| variant_3647 | FWKKLKKIPKFLKAAKKF | seqid_2741 |
| variant_3648 | KKKLFLKIPPPKFKKAAKKF | seqid_2742 |
| variant_3649 | RKKLFLKIPPPKFKKAAKKF | seqid_2743 |

| | | |
|---|---|---|
| variant_3650 | FKKLFLKIPPPKFKKAAKKF | seqid_2744 |
| variant_3651 | KWKLFLKIPPPKFKKAAKKF | seqid_2745 |
| variant_3652 | RWKLFLKIPPPKFKKAAKKF | seqid_2746 |
| variant_3653 | FWKLFLKIPPPKFKKAAKKF | seqid_2747 |
| variant_3654 | KKKKFLKIPPPKFKKAAKKF | seqid_2748 |
| variant_3655 | RKKKFLKIPPPKFKKAAKKF | seqid_2749 |
| variant_3656 | FKKKFLKIPPPKFKKAAKKF | seqid_2750 |
| variant_3657 | KWKKFLKIPPPKFKKAAKKF | seqid_2751 |
| variant_3658 | RWKKFLKIPPPKFKKAAKKF | seqid_2752 |
| variant_3659 | FWKKFLKIPPPKFKKAAKKF | seqid_2753 |
| variant_3660 | KKKLLLKIPPPKFKKAAKKF | seqid_2754 |
| variant_3661 | RKKLLLKIPPPKFKKAAKKF | seqid_2755 |
| variant_3662 | FKKLLLKIPPPKFKKAAKKF | seqid_2756 |
| variant_3663 | KWKLLLKIPPPKFKKAAKKF | seqid_2757 |
| variant_3664 | RWKLLLKIPPPKFKKAAKKF | seqid_2758 |
| variant_3665 | FWKLLLKIPPPKFKKAAKKF | seqid_2759 |
| variant_3666 | KKKKLLKIPPPKFKKAAKKF | seqid_2760 |
| variant_3667 | RKKKLLKIPPPKFKKAAKKF | seqid_2761 |
| variant_3668 | FKKKLLKIPPPKFKKAAKKF | seqid_2762 |
| variant_3669 | KWKKLLKIPPPKFKKAAKKF | seqid_2763 |
| variant_3670 | RWKKLLKIPPPKFKKAAKKF | seqid_2764 |
| variant_3671 | FWKKLLKIPPPKFKKAAKKF | seqid_2765 |
| variant_3672 | KKKLFKKIPPPKFKKAAKKF | seqid_2766 |
| variant_3673 | RKKLFKKIPPPKFKKAAKKF | seqid_2767 |
| variant_3674 | FKKLFKKIPPPKFKKAAKKF | seqid_2768 |
| variant_3675 | KWKLFKKIPPPKFKKAAKKF | seqid_2769 |
| variant_3676 | RWKLFKKIPPPKFKKAAKKF | seqid_2770 |
| variant_3677 | FWKLFKKIPPPKFKKAAKKF | seqid_2771 |
| variant_3678 | KKKKFKKIPPPKFKKAAKKF | seqid_2772 |
| variant_3679 | RKKKFKKIPPPKFKKAAKKF | seqid_2773 |
| variant_3680 | FKKKFKKIPPPKFKKAAKKF | seqid_2774 |
| variant_3681 | KWKKFKKIPPPKFKKAAKKF | seqid_2775 |
| variant_3682 | RWKKFKKIPPPKFKKAAKKF | seqid_2776 |
| variant_3683 | FWKKFKKIPPPKFKKAAKKF | seqid_2777 |
| variant_3684 | KKKLLKKIPPPKFKKAAKKF | seqid_2778 |
| variant_3685 | RKKLLKKIPPPKFKKAAKKF | seqid_2779 |
| variant_3686 | FKKLLKKIPPPKFKKAAKKF | seqid_2780 |
| variant_3687 | KWKLLKKIPPPKFKKAAKKF | seqid_2781 |
| variant_3688 | RWKLLKKIPPPKFKKAAKKF | seqid_2782 |
| variant_3689 | FWKLLKKIPPPKFKKAAKKF | seqid_2783 |
| variant_3690 | KKKKLKKIPPPKFKKAAKKF | seqid_2784 |
| variant_3691 | RKKKLKKIPPPKFKKAAKKF | seqid_2785 |
| variant_3692 | FKKKLKKIPPPKFKKAAKKF | seqid_2786 |
| variant_3693 | KWKKLKKIPPPKFKKAAKKF | seqid_2787 |
| variant_3694 | RWKKLKKIPPPKFKKAAKKF | seqid_2788 |
| variant_3695 | FWKKLKKIPPPKFKKAAKKF | seqid_2789 |
| variant_3696 | KKKLFLKIPPKFKKAAKKF | seqid_2790 |
| variant_3697 | RKKLFLKIPPKFKKAAKKF | seqid_2791 |
| variant_3698 | FKKLFLKIPPKFKKAAKKF | seqid_2792 |
| variant_3699 | KWKLFLKIPPKFKKAAKKF | seqid_2793 |
| variant_3700 | RWKLFLKIPPKFKKAAKKF | seqid_2794 |
| variant_3701 | FWKLFLKIPPKFKKAAKKF | seqid_2795 |
| variant_3702 | KKKKFLKIPPKFKKAAKKF | seqid_2796 |
| variant_3703 | RKKKFLKIPPKFKKAAKKF | seqid_2797 |
| variant_3704 | FKKKFLKIPPKFKKAAKKF | seqid_2798 |
| variant_3705 | KWKKFLKIPPKFKKAAKKF | seqid_2799 |
| variant_3706 | RWKKFLKIPPKFKKAAKKF | seqid_2800 |
| variant_3707 | FWKKFLKIPPKFKKAAKKF | seqid_2801 |
| variant_3708 | KKKLLLKIPPKFKKAAKKF | seqid_2802 |
| variant_3709 | RKKLLLKIPPKFKKAAKKF | seqid_2803 |
| variant_3710 | FKKLLLKIPPKFKKAAKKF | seqid_2804 |
| variant_3711 | KWKLLLKIPPKFKKAAKKF | seqid_2805 |
| variant_3712 | RWKLLLKIPPKFKKAAKKF | seqid_2806 |
| variant_3713 | FWKLLLKIPPKFKKAAKKF | seqid_2807 |
| variant_3714 | KKKKLLKIPPKFKKAAKKF | seqid_2808 |
| variant_3715 | RKKKLLKIPPKFKKAAKKF | seqid_2809 |
| variant_3716 | FKKKLLKIPPKFKKAAKKF | seqid_2810 |
| variant_3717 | KWKKLLKIPPKFKKAAKKF | seqid_2811 |
| variant_3718 | RWKKLLKIPPKFKKAAKKF | seqid_2812 |
| variant_3719 | FWKKLLKIPPKFKKAAKKF | seqid_2813 |
| variant_3720 | KKKLFKKIPPKFKKAAKKF | seqid_2814 |
| variant_3721 | RKKLFKKIPPKFKKAAKKF | seqid_2815 |
| variant_3722 | FKKLFKKIPPKFKKAAKKF | seqid_2816 |
| variant_3723 | KWKLFKKIPPKFKKAAKKF | seqid_2817 |
| variant_3724 | RWKLFKKIPPKFKKAAKKF | seqid_2818 |
| variant_3725 | FWKLFKKIPPKFKKAAKKF | seqid_2819 |
| variant_3726 | KKKKFKKIPPKFKKAAKKF | seqid_2820 |
| variant_3727 | RKKKFKKIPPKFKKAAKKF | seqid_2821 |
| variant_3728 | FKKKFKKIPPKFKKAAKKF | seqid_2822 |
| variant_3729 | KWKKFKKIPPKFKKAAKKF | seqid_2823 |
| variant_3730 | RWKKFKKIPPKFKKAAKKF | seqid_2824 |

| | | |
|---|---|---|
| variant_3731 | FWKKFKKIPPKFKKAAKKF | seqid_2825 |
| variant_3732 | KKKLLKKIPPKFKKAAKKF | seqid_2826 |
| variant_3733 | RKKLLKKIPPKFKKAAKKF | seqid_2827 |
| variant_3734 | FKKLLKKIPPKFKKAAKKF | seqid_2828 |
| variant_3735 | KWKLLKKIPPKFKKAAKKF | seqid_2829 |
| variant_3736 | RWKLLKKIPPKFKKAAKKF | seqid_2830 |
| variant_3737 | FWKLLKKIPPKFKKAAKKF | seqid_2831 |
| variant_3738 | KKKKLKKIPPKFKKAAKKF | seqid_2832 |
| variant_3739 | RKKKLKKIPPKFKKAAKKF | seqid_2833 |
| variant_3740 | FKKKLKKIPPKFKKAAKKF | seqid_2834 |
| variant_3741 | KWKKLKKIPPKFKKAAKKF | seqid_2835 |
| variant_3742 | RWKKLKKIPPKFKKAAKKF | seqid_2836 |
| variant_3743 | FWKKLKKIPPKFKKAAKKF | seqid_2837 |
| variant_3792 | KKKLFLKIPKFKKAAKKF | seqid_2838 |
| variant_3793 | RKKLFLKIPKFKKAAKKF | seqid_2839 |
| variant_3794 | FKKLFLKIPKFKKAAKKF | seqid_2840 |
| variant_3795 | KWKLFLKIPKFKKAAKKF | seqid_2841 |
| variant_3796 | RWKLFLKIPKFKKAAKKF | seqid_2842 |
| variant_3797 | FWKLFLKIPKFKKAAKKF | seqid_2843 |
| variant_3798 | KKKKFLKIPKFKKAAKKF | seqid_2844 |
| variant_3799 | RKKKFLKIPKFKKAAKKF | seqid_2845 |
| variant_3800 | FKKKFLKIPKFKKAAKKF | seqid_2846 |
| variant_3801 | KWKKFLKIPKFKKAAKKF | seqid_2847 |
| variant_3802 | RWKKFLKIPKFKKAAKKF | seqid_2848 |
| variant_3803 | FWKKFLKIPKFKKAAKKF | seqid_2849 |
| variant_3804 | KKKLLLKIPKFKKAAKKF | seqid_2850 |
| variant_3805 | RKKLLLKIPKFKKAAKKF | seqid_2851 |
| variant_3806 | FKKLLLKIPKFKKAAKKF | seqid_2852 |
| variant_3807 | KWKLLLKIPKFKKAAKKF | seqid_2853 |
| variant_3808 | RWKLLLKIPKFKKAAKKF | seqid_2854 |
| variant_3809 | FWKLLLKIPKFKKAAKKF | seqid_2855 |
| variant_3810 | KKKKLLKIPKFKKAAKKF | seqid_2856 |
| variant_3811 | RKKKLLKIPKFKKAAKKF | seqid_2857 |
| variant_3812 | FKKKLLKIPKFKKAAKKF | seqid_2858 |
| variant_3813 | KWKKLLKIPKFKKAAKKF | seqid_2859 |
| variant_3814 | RWKKLLKIPKFKKAAKKF | seqid_2860 |
| variant_3815 | FWKKLLKIPKFKKAAKKF | seqid_2861 |
| variant_3816 | KKKLFKKIPKFKKAAKKF | seqid_2862 |
| variant_3817 | RKKLFKKIPKFKKAAKKF | seqid_2863 |
| variant_3818 | FKKLFKKIPKFKKAAKKF | seqid_2864 |
| variant_3819 | KWKLFKKIPKFKKAAKKF | seqid_2865 |
| variant_3820 | RWKLFKKIPKFKKAAKKF | seqid_2866 |
| variant_3821 | FWKLFKKIPKFKKAAKKF | seqid_2867 |
| variant_3822 | KKKKFKKIPKFKKAAKKF | seqid_2868 |
| variant_3823 | RKKKFKKIPKFKKAAKKF | seqid_2869 |
| variant_3824 | FKKKFKKIPKFKKAAKKF | seqid_2870 |
| variant_3825 | KWKKFKKIPKFKKAAKKF | seqid_2871 |
| variant_3826 | RWKKFKKIPKFKKAAKKF | seqid_2872 |
| variant_3827 | FWKKFKKIPKFKKAAKKF | seqid_2873 |
| variant_3828 | KKKLLKKIPKFKKAAKKF | seqid_2874 |
| variant_3829 | RKKLLKKIPKFKKAAKKF | seqid_2875 |
| variant_3830 | FKKLLKKIPKFKKAAKKF | seqid_2876 |
| variant_3831 | KWKLLKKIPKFKKAAKKF | seqid_2877 |
| variant_3832 | RWKLLKKIPKFKKAAKKF | seqid_2878 |
| variant_3833 | FWKLLKKIPKFKKAAKKF | seqid_2879 |
| variant_3834 | KKKKLKKIPKFKKAAKKF | seqid_2880 |
| variant_3835 | RKKKLKKIPKFKKAAKKF | seqid_2881 |
| variant_3836 | FKKKLKKIPKFKKAAKKF | seqid_2882 |
| variant_3837 | KWKKLKKIPKFKKAAKKF | seqid_2883 |
| variant_3838 | RWKKLKKIPKFKKAAKKF | seqid_2884 |
| variant_3839 | FWKKLKKIPKFKKAAKKF | seqid_2885 |
| variant_3840 | KKKLFLKIPPPKFLHLAKKF | seqid_2886 |
| variant_3841 | RKKLFLKIPPPKFLHLAKKF | seqid_2887 |
| variant_3842 | FKKLFLKIPPPKFLHLAKKF | seqid_2888 |
| variant_3843 | KWKLFLKIPPPKFLHLAKKF | seqid_2889 |
| variant_3844 | RWKLFLKIPPPKFLHLAKKF | seqid_2890 |
| variant_3845 | FWKLFLKIPPPKFLHLAKKF | seqid_2891 |
| variant_3846 | KKKKFLKIPPPKFLHLAKKF | seqid_2892 |
| variant_3847 | RKKKFLKIPPPKFLHLAKKF | seqid_2893 |
| variant_3848 | FKKKFLKIPPPKFLHLAKKF | seqid_2894 |
| variant_3849 | KWKKFLKIPPPKFLHLAKKF | seqid_2895 |
| variant_3850 | RWKKFLKIPPPKFLHLAKKF | seqid_2896 |
| variant_3851 | FWKKFLKIPPPKFLHLAKKF | seqid_2897 |
| variant_3852 | KKKLLLKIPPPKFLHLAKKF | seqid_2898 |
| variant_3853 | RKKLLLKIPPPKFLHLAKKF | seqid_2899 |
| variant_3854 | FKKLLLKIPPPKFLHLAKKF | seqid_2900 |
| variant_3855 | KWKLLLKIPPPKFLHLAKKF | seqid_2901 |
| variant_3856 | RWKLLLKIPPPKFLHLAKKF | seqid_2902 |
| variant_3857 | FWKLLLKIPPPKFLHLAKKF | seqid_2903 |
| variant_3858 | KKKKLLKIPPPKFLHLAKKF | seqid_2904 |
| variant_3859 | RKKKLLKIPPPKFLHLAKKF | seqid_2905 |

| | | |
|---|---|---|
| variant_3860 | FKKKLLKIPPPKFLHLAKKF | seqid_2906 |
| variant_3861 | KWKKLLKIPPPKFLHLAKKF | seqid_2907 |
| variant_3862 | RWKKLLKIPPPKFLHLAKKF | seqid_2908 |
| variant_3863 | FWKKLLKIPPPKFLHLAKKF | seqid_2909 |
| variant_3864 | KKKLFKKIPPPKFLHLAKKF | seqid_2910 |
| variant_3865 | RKKLFKKIPPPKFLHLAKKF | seqid_2911 |
| variant_3866 | FKKLFKKIPPPKFLHLAKKF | seqid_2912 |
| variant_3867 | KWKLFKKIPPPKFLHLAKKF | seqid_2913 |
| variant_3868 | RWKLFKKIPPPKFLHLAKKF | seqid_2914 |
| variant_3869 | FWKLFKKIPPPKFLHLAKKF | seqid_2915 |
| variant_3870 | KKKKFKKIPPPKFLHLAKKF | seqid_2916 |
| variant_3871 | RKKKFKKIPPPKFLHLAKKF | seqid_2917 |
| variant_3872 | FKKKFKKIPPPKFLHLAKKF | seqid_2918 |
| variant_3873 | KWKKFKKIPPPKFLHLAKKF | seqid_2919 |
| variant_3874 | RWKKFKKIPPPKFLHLAKKF | seqid_2920 |
| variant_3875 | FWKKFKKIPPPKFLHLAKKF | seqid_2921 |
| variant_3876 | KKKLLKKIPPPKFLHLAKKF | seqid_2922 |
| variant_3877 | RKKLLKKIPPPKFLHLAKKF | seqid_2923 |
| variant_3878 | FKKLLKKIPPPKFLHLAKKF | seqid_2924 |
| variant_3879 | KWKLLKKIPPPKFLHLAKKF | seqid_2925 |
| variant_3880 | RWKLLKKIPPPKFLHLAKKF | seqid_2926 |
| variant_3881 | FWKLLKKIPPPKFLHLAKKF | seqid_2927 |
| variant_3882 | KKKKLKKIPPPKFLHLAKKF | seqid_2928 |
| variant_3883 | RKKKLKKIPPPKFLHLAKKF | seqid_2929 |
| variant_3884 | FKKKLKKIPPPKFLHLAKKF | seqid_2930 |
| variant_3885 | KWKKLKKIPPPKFLHLAKKF | seqid_2931 |
| variant_3886 | RWKKLKKIPPPKFLHLAKKF | seqid_2932 |
| variant_3887 | FWKKLKKIPPPKFLHLAKKF | seqid_2933 |
| variant_3888 | KKKLFLKIPPPKFLHLAKKF | seqid_2934 |
| variant_3889 | RKKLFLKIPPPKFLHLAKKF | seqid_2935 |
| variant_3890 | FKKLFLKIPPPKFLHLAKKF | seqid_2936 |
| variant_3891 | KWKLFLKIPPPKFLHLAKKF | seqid_2937 |
| variant_3892 | RWKLFLKIPPPKFLHLAKKF | seqid_2938 |
| variant_3893 | FWKLFLKIPPPKFLHLAKKF | seqid_2939 |
| variant_3894 | KKKKFLKIPPPKFLHLAKKF | seqid_2940 |
| variant_3895 | RKKKFLKIPPPKFLHLAKKF | seqid_2941 |
| variant_3896 | FKKKFLKIPPPKFLHLAKKF | seqid_2942 |
| variant_3897 | KWKKFLKIPPPKFLHLAKKF | seqid_2943 |
| variant_3898 | RWKKFLKIPPPKFLHLAKKF | seqid_2944 |
| variant_3899 | FWKKFLKIPPPKFLHLAKKF | seqid_2945 |
| variant_3900 | KKKLLLKIPPKFLHLAKKF | seqid_2946 |
| variant_3901 | RKKLLLKIPPKFLHLAKKF | seqid_2947 |
| variant_3902 | FKKLLLKIPPKFLHLAKKF | seqid_2948 |
| variant_3903 | KWKLLLKIPPKFLHLAKKF | seqid_2949 |
| variant_3904 | RWKLLLKIPPKFLHLAKKF | seqid_2950 |
| variant_3905 | FWKLLLKIPPKFLHLAKKF | seqid_2951 |
| variant_3906 | KKKKLLKIPPKFLHLAKKF | seqid_2952 |
| variant_3907 | RKKKLLKIPPKFLHLAKKF | seqid_2953 |
| variant_3908 | FKKKLLKIPPKFLHLAKKF | seqid_2954 |
| variant_3909 | KWKKLLKIPPKFLHLAKKF | seqid_2955 |
| variant_3910 | RWKKLLKIPPKFLHLAKKF | seqid_2956 |
| variant_3911 | FWKKLLKIPPKFLHLAKKF | seqid_2957 |
| variant_3912 | KKKLFKKIPPKFLHLAKKF | seqid_2958 |
| variant_3913 | RKKLFKKIPPKFLHLAKKF | seqid_2959 |
| variant_3914 | FKKLFKKIPPKFLHLAKKF | seqid_2960 |
| variant_3915 | KWKLFKKIPPKFLHLAKKF | seqid_2961 |
| variant_3916 | RWKLFKKIPPKFLHLAKKF | seqid_2962 |
| variant_3917 | FWKLFKKIPPKFLHLAKKF | seqid_2963 |
| variant_3918 | KKKKFKKIPPKFLHLAKKF | seqid_2964 |
| variant_3919 | RKKKFKKIPPKFLHLAKKF | seqid_2965 |
| variant_3920 | FKKKFKKIPPKFLHLAKKF | seqid_2966 |
| variant_3921 | KWKKFKKIPPKFLHLAKKF | seqid_2967 |
| variant_3922 | RWKKFKKIPPKFLHLAKKF | seqid_2968 |
| variant_3923 | FWKKFKKIPPKFLHLAKKF | seqid_2969 |
| variant_3924 | KKKLLKKIPPKFLHLAKKF | seqid_2970 |
| variant_3925 | RKKLLKKIPPKFLHLAKKF | seqid_2971 |
| variant_3926 | FKKLLKKIPPKFLHLAKKF | seqid_2972 |
| variant_3927 | KWKLLKKIPPKFLHLAKKF | seqid_2973 |
| variant_3928 | RWKLLKKIPPKFLHLAKKF | seqid_2974 |
| variant_3929 | FWKLLKKIPPKFLHLAKKF | seqid_2975 |
| variant_3930 | KKKKLKKIPPKFLHLAKKF | seqid_2976 |
| variant_3931 | RKKKLKKIPPKFLHLAKKF | seqid_2977 |
| variant_3932 | FKKKLKKIPPKFLHLAKKF | seqid_2978 |
| variant_3933 | KWKKLKKIPPKFLHLAKKF | seqid_2979 |
| variant_3934 | RWKKLKKIPPKFLHLAKKF | seqid_2980 |
| variant_3935 | FWKKLKKIPPKFLHLAKKF | seqid_2981 |
| variant_3984 | KKKLFLKIPKFLHLAKKF | seqid_2982 |
| variant_3985 | RKKLFLKIPKFLHLAKKF | seqid_2983 |
| variant_3986 | FKKLFLKIPKFLHLAKKF | seqid_2984 |
| variant_3987 | KWKLFLKIPKFLHLAKKF | seqid_2985 |
| variant_3988 | RWKLFLKIPKFLHLAKKF | seqid_2986 |

-continued

| | | |
|---|---|---|
| variant_3989 | FWKLFLKIPKFLHLAKKF | seqid_2987 |
| variant_3990 | KKKKFLKIPKFLHLAKKF | seqid_2988 |
| variant_3991 | RKKKFLKIPKFLHLAKKF | seqid_2989 |
| variant_3992 | FKKKFLKIPKFLHLAKKF | seqid_2990 |
| variant_3993 | KWKKFLKIPKFLHLAKKF | seqid_2991 |
| variant_3994 | RWKKFLKIPKFLHLAKKF | seqid_2992 |
| variant_3995 | FWKKFLKIPKFLHLAKKF | seqid_2993 |
| variant_3996 | KKKLLLKIPKFLHLAKKF | seqid_2994 |
| variant_3997 | RKKLLLKIPKFLHLAKKF | seqid_2995 |
| variant_3998 | FKKLLLKIPKFLHLAKKF | seqid_2996 |
| variant_3999 | KWKLLLKIPKFLHLAKKF | seqid_2997 |
| variant_4000 | RWKLLLKIPKFLHLAKKF | seqid_2998 |
| variant_4001 | FWKLLLKIPKFLHLAKKF | seqid_2999 |
| variant_4002 | KKKKLLKIPKFLHLAKKF | seqid_3000 |
| variant_4003 | RKKKLLKIPKFLHLAKKF | seqid_3001 |
| variant_4004 | FKKKLLKIPKFLHLAKKF | seqid_3002 |
| variant_4005 | KWKKLLKIPKFLHLAKKF | seqid_3003 |
| variant_4006 | RWKKLLKIPKFLHLAKKF | seqid_3004 |
| variant_4007 | FWKKLLKIPKFLHLAKKF | seqid_3005 |
| variant_4008 | KKKLFKKIPKFLHLAKKF | seqid_3006 |
| variant_4009 | RKKLFKKIPKFLHLAKKF | seqid_3007 |
| variant_4010 | FKKLFKKIPKFLHLAKKF | seqid_3008 |
| variant_4011 | KWKLFKKIPKFLHLAKKF | seqid_3 |
| variant_4012 | RWKLFKKIPKFLHLAKKF | seqid_4 |
| variant_4013 | FWKLFKKIPKFLHLAKKF | seqid_3009 |
| variant_4014 | KKKKFKKIPKFLHLAKKF | seqid_3010 |
| variant_4015 | RKKKFKKIPKFLHLAKKF | seqid_3011 |
| variant_4016 | FKKKFKKIPKFLHLAKKF | seqid_3012 |
| variant_4017 | KWKKFKKIPKFLHLAKKF | seqid_3013 |
| variant_4018 | RWKKFKKIPKFLHLAKKF | seqid_3014 |
| variant_4019 | FWKKFKKIPKFLHLAKKF | seqid_3015 |
| variant_4020 | KKKLLKKIPKFLHLAKKF | seqid_3016 |
| variant_4021 | RKKLLKKIPKFLHLAKKF | seqid_3017 |
| variant_4022 | FKKLLKKIPKFLHLAKKF | seqid_3018 |
| variant_4023 | KWKLLKKIPKFLHLAKKF | seqid_3019 |
| variant_4024 | RWKLLKKIPKFLHLAKKF | seqid_3020 |
| variant_4025 | FWKLLKKIPKFLHLAKKF | seqid_3021 |
| variant_4026 | KKKKLKKIPKFLHLAKKF | seqid_3022 |
| variant_4027 | RKKKLKKIPKFLHLAKKF | seqid_3023 |
| variant_4028 | FKKKLKKIPKFLHLAKKF | seqid_3024 |
| variant_4029 | KWKKLKKIPKFLHLAKKF | seqid_3025 |
| variant_4030 | RWKKLKKIPKFLHLAKKF | seqid_3026 |
| variant_4031 | FWKKLKKIPKFLHLAKKF | seqid_3027 |
| variant_4032 | KKKLFLKIPPPKFKHLAKKF | seqid_3028 |
| variant_4033 | RKKLFLKIPPPKFKHLAKKF | seqid_3029 |
| variant_4034 | FKKLFLKIPPPKFKHLAKKF | seqid_3030 |
| variant_4035 | KWKLFLKIPPPKFKHLAKKF | seqid_3031 |
| variant_4036 | RWKLFLKIPPPKFKHLAKKF | seqid_3032 |
| variant_4037 | FWKLFLKIPPPKFKHLAKKF | seqid_3033 |
| variant_4038 | KKKKFLKIPPPKFKHLAKKF | seqid_3034 |
| variant_4039 | RKKKFLKIPPPKFKHLAKKF | seqid_3035 |
| variant_4040 | FKKKFLKIPPPKFKHLAKKF | seqid_3036 |
| variant_4041 | KWKKFLKIPPPKFKHLAKKF | seqid_3037 |
| variant_4042 | RWKKFLKIPPPKFKHLAKKF | seqid_3038 |
| variant_4043 | FWKKFLKIPPPKFKHLAKKF | seqid_3039 |
| variant_4044 | KKKLLLKIPPPKFKHLAKKF | seqid_3040 |
| variant_4045 | RKKLLLKIPPPKFKHLAKKF | seqid_3041 |
| variant_4046 | FKKLLLKIPPPKFKHLAKKF | seqid_3042 |
| variant_4047 | KWKLLLKIPPPKFKHLAKKF | seqid_3043 |
| variant_4048 | RWKLLLKIPPPKFKHLAKKF | seqid_3044 |
| variant_4049 | FWKLLLKIPPPKFKHLAKKF | seqid_3045 |
| variant_4050 | KKKKLLKIPPPKFKHLAKKF | seqid_3046 |
| variant_4051 | RKKKLLKIPPPKFKHLAKKF | seqid_3047 |
| variant_4052 | FKKKLLKIPPPKFKHLAKKF | seqid_3048 |
| variant_4053 | KWKKLLKIPPPKFKHLAKKF | seqid_3049 |
| variant_4054 | RWKKLLKIPPPKFKHLAKKF | seqid_3050 |
| variant_4055 | FWKKLLKIPPPKFKHLAKKF | seqid_3051 |
| variant_4056 | KKKLFKKIPPPKFKHLAKKF | seqid_3052 |
| variant_4057 | RKKLFKKIPPPKFKHLAKKF | seqid_3053 |
| variant_4058 | FKKLFKKIPPPKFKHLAKKF | seqid_3054 |
| variant_4059 | KWKLFKKIPPPKFKHLAKKF | seqid_3055 |
| variant_4060 | RWKLFKKIPPPKFKHLAKKF | seqid_3056 |
| variant_4061 | FWKLFKKIPPPKFKHLAKKF | seqid_3057 |
| variant_4062 | KKKKFKKIPPPKFKHLAKKF | seqid_3058 |
| variant_4063 | RKKKFKKIPPPKFKHLAKKF | seqid_3059 |
| variant_4064 | FKKKFKKIPPPKFKHLAKKF | seqid_3060 |
| variant_4065 | KWKKFKKIPPPKFKHLAKKF | seqid_3061 |
| variant_4066 | RWKKFKKIPPPKFKHLAKKF | seqid_3062 |
| variant_4067 | FWKKFKKIPPPKFKHLAKKF | seqid_3063 |
| variant_4068 | KKKLLKKIPPPKFKHLAKKF | seqid_3064 |
| variant_4069 | RKKLLKKIPPPKFKHLAKKF | seqid_3065 |

| | | |
|---|---|---|
| variant_4070 | FKKLLKKIPPPKFKHLAKKF | seqid_3066 |
| variant_4071 | KWKLLKKIPPPKFKHLAKKF | seqid_3067 |
| variant_4072 | RWKLLKKIPPPKFKHLAKKF | seqid_3068 |
| variant_4073 | FWKLLKKIPPPKFKHLAKKF | seqid_3069 |
| variant_4074 | KKKKLKKIPPPKFKHLAKKF | seqid_3070 |
| variant_4075 | RKKKLKKIPPPKFKHLAKKF | seqid_3071 |
| variant_4076 | FKKKLKKIPPPKFKHLAKKF | seqid_3072 |
| variant_4077 | KWKKLKKIPPPKFKHLAKKF | seqid_3073 |
| variant_4078 | RWKKLKKPPPKFKHLAKKF | seqid_3074 |
| variant_4079 | FWKKLKKIPPPKFKHLAKKF | seqid_3075 |
| variant_4080 | KKKLFLKIPPKFKHLAKKF | seqid_3076 |
| variant_4081 | RKKLFLKIPPKFKHLAKKF | seqid_3077 |
| variant_4082 | FKKLFLKIPPKFKHLAKKF | seqid_3078 |
| variant_4083 | KWKLFLKIPPKFKHLAKKF | seqid_3079 |
| variant_4084 | RWKLFLKIPPKFKHLAKKF | seqid_3080 |
| variant_4085 | FWKLFLKIPPKFKHLAKKF | seqid_3081 |
| variant_4086 | KKKKFLKIPPKFKHLAKKF | seqid_3082 |
| variant_4087 | RKKKFLKIPPKFKHLAKKF | seqid_3083 |
| variant_4088 | FKKKFLKIPPKFKHLAKKF | seqid_3084 |
| variant_4089 | KWKKFLKIPPKFKHLAKKF | seqid_3085 |
| variant_4090 | RWKKFLKIPPKFKHLAKKF | seqid_3086 |
| variant_4091 | FWKKFLKIPPKFKHLAKKF | seqid_3087 |
| variant_4092 | KKKLLLKIPPKFKHLAKKF | seqid_3088 |
| variant_4093 | RKKLLLKIPPKFKHLAKKF | seqid_3089 |
| variant_4094 | FKKLLLKIPPKFKHLAKKF | seqid_3090 |
| variant_4095 | KWKLLLKIPPKFKHLAKKF | seqid_3091 |
| variant_4096 | RWKLLLKIPPKFKHLAKKF | seqid_3092 |
| variant_4097 | FWKLLLKIPPKFKHLAKKF | seqid_3093 |
| variant_4098 | KKKKLLKIPPKFKHLAKKF | seqid_3094 |
| variant_4099 | RKKKLLKIPPKFKHLAKKF | seqid_3095 |
| variant_4100 | FKKKLLKIPPKFKHLAKKF | seqid_3096 |
| variant_4101 | KWKKLLKIPPKFKHLAKKF | seqid_3097 |
| variant_4102 | RWKKLLKIPPKFKHLAKKF | seqid_3098 |
| variant_4103 | FWKKLLKIPPKFKHLAKKF | seqid_3099 |
| variant_4104 | KKKLFKKIPPKFKHLAKKF | seqid_3100 |
| variant_4105 | RKKLFKKIPPKFKHLAKKF | seqid_3101 |
| variant_4106 | FKKLFKKIPPKFKHLAKKF | seqid_3102 |
| variant_4107 | KWKLFKKIPPKFKHLAKKF | seqid_3103 |
| variant_4108 | RWKLFKKIPPKFKHLAKKF | seqid_3104 |
| variant_4109 | FWKLFKKIPPKFKHLAKKF | seqid_3105 |
| variant_4110 | KKKKFKKIPPKFKHLAKKF | seqid_3106 |
| variant_4111 | RKKKFKKIPPKFKHLAKKF | seqid_3107 |
| variant_4112 | FKKKFKKIPPKFKHLAKKF | seqid_3108 |
| variant_4113 | KWKKFKKIPPKFKHLAKKF | seqid_3109 |
| variant_4114 | RWKKFKKIPPKFKHLAKKF | seqid_3110 |
| variant_4115 | FWKKFKKIPPKFKHLAKKF | seqid_3111 |
| variant_4116 | KKKLLKKIPPKFKHLAKKF | seqid_3112 |
| variant_4117 | RKKLLKKIPPKFKHLAKKF | seqid_3113 |
| variant_4118 | FKKLLKKIPPKFKHLAKKF | seqid_3114 |
| variant_4119 | KWKLLKKIPPKFKHLAKKF | seqid_3115 |
| variant_4120 | RWKLLKKIPPKFKHLAKKF | seqid_3116 |
| variant_4121 | FWKLLKKIPPKFKHLAKKF | seqid_3117 |
| variant_4122 | KKKKLKKIPPKFKHLAKKF | seqid_3118 |
| variant_4123 | RKKKLKKIPPKFKHLAKKF | seqid_3119 |
| variant_4124 | FKKKLKKIPPKFKHLAKKF | seqid_3120 |
| variant_4125 | KWKKLKKIPPKFKHLAKKF | seqid_3121 |
| variant_4126 | RWKKLKKIPPKFKHLAKKF | seqid_3122 |
| variant_4127 | FWKKLKKIPPKFKHLAKKF | seqid_3123 |
| variant_4176 | KKKLFLKIPKFKHLAKKF | seqid_3124 |
| variant_4177 | RKKLFLKIPKFKHLAKKF | seqid_3125 |
| variant_4178 | FKKLFLKIPKFKHLAKKF | seqid_3126 |
| variant_4179 | KWKLFLKIPKFKHLAKKF | seqid_3127 |
| variant_4180 | RWKLFLKIPKFKHLAKKF | seqid_3128 |
| variant_4181 | FWKLFLKIPKFKHLAKKF | seqid_3129 |
| variant_4182 | KKKKFLKIPKFKHLAKKF | seqid_3130 |
| variant_4183 | RKKKFLKIPKFKHLAKKF | seqid_3131 |
| variant_4184 | FKKKFLKIPKFKHLAKKF | seqid_3132 |
| variant_4185 | KWKKFLKIPKFKHLAKKF | seqid_3133 |
| variant_4186 | RWKKFLKIPKFKHLAKKF | seqid_3134 |
| variant_4187 | FWKKFLKIPKFKHLAKKF | seqid_3135 |
| variant_4188 | KKKLLLKIPKFKHLAKKF | seqid_3136 |
| variant_4189 | RKKLLLKIPKFKHLAKKF | seqid_3137 |
| variant_4190 | FKKLLLKIPKFKHLAKKF | seqid_3138 |
| variant_4191 | KWKLLLKIPKFKHLAKKF | seqid_3139 |
| variant_4192 | RWKLLLKIPKFKHLAKKF | seqid_3140 |
| variant_4193 | FWKLLLKIPKFKHLAKKF | seqid_3141 |
| variant_4194 | KKKKLLKIPKFKHLAKKF | seqid_3142 |
| variant_4195 | RKKKLLKIPKFKHLAKKF | seqid_3143 |
| variant_4196 | FKKKLLKIPKFKHLAKKF | seqid_3144 |
| variant_4197 | KWKKLLKIPKFKHLAKKF | seqid_3145 |
| variant_4198 | RWKKLLKIPKFKHLAKKF | seqid_3146 |

| | | |
|---|---|---|
| variant_4199 | FWKKLLKIPKFKHLAKKF | seqid_3147 |
| variant_4200 | KKKLFKKIPKFKHLAKKF | seqid_3148 |
| variant_4201 | RKKLFKKIPKFKHLAKKF | seqid_3149 |
| variant_4202 | FKKLFKKIPKFKHLAKKF | seqid_3150 |
| variant_4203 | KWKLFKKIPKFKHLAKKF | seqid_3151 |
| variant_4204 | RWKLFKKIPKFKHLAKKF | seqid_3152 |
| variant_4205 | FWKLFKKIPKFKHLAKKF | seqid_3153 |
| variant_4206 | KKKKFKKIPKFKHLAKKF | seqid_3154 |
| variant_4207 | RKKKFKKIPKFKHLAKKF | seqid_3155 |
| variant_4208 | FKKKFKKIPKFKHLAKKF | seqid_3156 |
| variant_4209 | KWKKFKKIPKFKHLAKKF | seqid_3157 |
| variant_4210 | RWKKFKKIPKFKHLAKKF | seqid_3158 |
| variant_4211 | FWKKFKKIPKFKHLAKKF | seqid_3159 |
| variant_4212 | KKKLLKKIPKFKHLAKKF | seqid_3160 |
| variant_4213 | RKKLLKKIPKFKHLAKKF | seqid_3161 |
| variant_4214 | FKKLLKKIPKFKHLAKKF | seqid_3162 |
| variant_4215 | KWKLLKKIPKFKHLAKKF | seqid_3163 |
| variant_4216 | RWKLLKKIPKFKHLAKKF | seqid_3164 |
| variant_4217 | FWKLLKKIPKFKHLAKKF | seqid_3165 |
| variant_4218 | KKKKLKKIPKFKHLAKKF | seqid_3166 |
| variant_4219 | RKKKLKKIPKFKHLAKKF | seqid_3167 |
| variant_4220 | FKKKLKKIPKFKHLAKKF | seqid_3168 |
| variant_4221 | KWKKLKKIPKFKHLAKKF | seqid_3169 |
| variant_4222 | RWKKLKKIPKFKHLAKKF | seqid_3170 |
| variant_4223 | FWKKLKKIPKFKHLAKKF | seqid_3171 |
| variant_4224 | KKKLFLKIPPPKFLKLAKKF | seqid_3172 |
| variant_4225 | RKKLFLKIPPPKFLKLAKKF | seqid_3173 |
| variant_4226 | FKKLFLKIPPPKFLKLAKKF | seqid_3174 |
| variant_4227 | KWKLFLKIPPPKFLKLAKKF | seqid_3175 |
| variant_4228 | RWKLFLKIPPPKFLKLAKKF | seqid_3176 |
| variant_4229 | FWKLFLKIPPPKFLKLAKKF | seqid_3177 |
| variant_4230 | KKKKFLKIPPPKFLKLAKKF | seqid_3178 |
| variant_4231 | RKKKFLKIPPPKFLKLAKKF | seqid_3179 |
| variant_4232 | FKKKFLKIPPPKFLKLAKKF | seqid_3180 |
| variant_4233 | KWKKFLKIPPPKFLKLAKKF | seqid_3181 |
| variant_4234 | RWKKFLKIPPPKFLKLAKKF | seqid_3182 |
| variant_4235 | FWKKFLKIPPPKFLKLAKKF | seqid_3183 |
| variant_4236 | KKKLLLKIPPPKFLKLAKKF | seqid_3184 |
| variant_4237 | RKKLLLKIPPPKFLKLAKKF | seqid_3185 |
| variant_4238 | FKKLLLKIPPPKFLKLAKKF | seqid_3186 |
| variant_4239 | KWKLLLKIPPPKFLKLAKKF | seqid_3187 |
| variant_4240 | RWKLLLKIPPPKFLKLAKKF | seqid_3188 |
| variant_4241 | FWKLLLKIPPPKFLKLAKKF | seqid_3189 |
| variant_4242 | KKKKLLKIPPPKFLKLAKKF | seqid_3190 |
| variant_4243 | RKKKLLKIPPPKFLKLAKKF | seqid_3191 |
| variant_4244 | FKKKLLKIPPPKFLKLAKKF | seqid_3192 |
| variant_4245 | KWKKLLKIPPPKFLKLAKKF | seqid_3193 |
| variant_4246 | RWKKLLKIPPPKFLKLAKKF | seqid_3194 |
| variant_4247 | FWKKLLKIPPPKFLKLAKKF | seqid_3195 |
| variant_4248 | KKKLFKKIPPPKFLKLAKKF | seqid_3196 |
| variant_4249 | RKKLFKKIPPPKFLKLAKKF | seqid_3197 |
| variant_4250 | FKKLFKKIPPPKFLKLAKKF | seqid_3198 |
| variant_4251 | KWKLFKKIPPPKFLKLAKKF | seqid_3199 |
| variant_4252 | RWKLFKKIPPPKFLKLAKKF | seqid_3200 |
| variant_4253 | FWKLFKKIPPPKFLKLAKKF | seqid_3201 |
| variant_4254 | KKKKFKKIPPPKFLKLAKKF | seqid_3202 |
| variant_4255 | RKKKFKKIPPPKFLKLAKKF | seqid_3203 |
| variant_4256 | FKKKFKKIPPPKFLKLAKKF | seqid_3204 |
| variant_4257 | KWKKFKKIPPPKFLKLAKKF | seqid_3205 |
| variant_4258 | RWKKFKKIPPPKFLKLAKKF | seqid_3206 |
| variant_4259 | FWKKFKKIPPPKFLKLAKKF | seqid_3207 |
| variant_4260 | KKKLLKKIPPPKFLKLAKKF | seqid_3208 |
| variant_4261 | RKKLLKKIPPPKFLKLAKKF | seqid_3209 |
| variant_4262 | FKKLLKKIPPPKFLKLAKKF | seqid_3210 |
| variant_4263 | KWKLLKKIPPPKFLKLAKKF | seqid_3211 |
| variant_4264 | RWKLLKKIPPPKFLKLAKKF | seqid_3212 |
| variant_4265 | FWKLLKKIPPPKFLKLAKKF | seqid_3213 |
| variant_4266 | KKKKLKKIPPPKFLKLAKKF | seqid_3214 |
| variant_4267 | RKKKLKKIPPPKFLKLAKKF | seqid_3215 |
| variant_4268 | FKKKLKKIPPPKFLKLAKKF | seqid_3216 |
| variant_4269 | KWKKLKKIPPPKFLKLAKKF | seqid_3217 |
| variant_4270 | RWKKLKKIPPPKFLKLAKKF | seqid_3218 |
| variant_4271 | FWKKLKKIPPPKFLKLAKKF | seqid_3219 |
| variant_4272 | KKKLFLKIPPKFLKLAKKF | seqid_3220 |
| variant_4273 | RKKLFLKIPPKFLKLAKKF | seqid_3221 |
| variant_4274 | FKKLFLKIPPKFLKLAKKF | seqid_3222 |
| variant_4275 | KWKLFLKIPPKFLKLAKKF | seqid_3223 |
| variant_4276 | RWKLFLKIPPKFLKLAKKF | seqid_3224 |
| variant_4277 | FWKLFLKIPPKFLKLAKKF | seqid_3225 |
| variant_4278 | KKKKFLKIPPKFLKLAKKF | seqid_3226 |
| variant_4279 | RKKKFLKIPPKFLKLAKKF | seqid_3227 |

| | | |
|---|---|---|
| variant_4280 | FKKKFLKIPPKFLKLAKKF | seqid_3228 |
| variant_4281 | KWKKFLKIPPKFLKLAKKF | seqid_3229 |
| variant_4282 | RWKKFLKIPPKFLKLAKKF | seqid_3230 |
| variant_4283 | FWKKFLKIPPKFLKLAKKF | seqid_3231 |
| variant_4284 | KKKLLLKIPPKFLKLAKKF | seqid_3232 |
| variant_4285 | RKKLLLKIPPKFLKLAKKF | seqid_3233 |
| variant_4286 | FKKLLLKIPPKFLKLAKKF | seqid_3234 |
| variant_4287 | KWKLLLKIPPKFLKLAKKF | seqid_3235 |
| variant_4288 | RWKLLLKIPPKFLKLAKKF | seqid_3236 |
| variant_4289 | FWKLLLKIPPKFLKLAKKF | seqid_3237 |
| variant_4290 | KKKKLLKIPPKFLKLAKKF | seqid_3238 |
| variant_4291 | RKKKLLKIPPKFLKLAKKF | seqid_3239 |
| variant_4292 | FKKKLLKIPPKFLKLAKKF | seqid_3240 |
| variant_4293 | KWKKLLKIPPKFLKLAKKF | seqid_3241 |
| variant_4294 | RWKKLLKIPPKFLKLAKKF | seqid_3242 |
| variant_4295 | FWKKLLKIPPKFLKLAKKF | seqid_3243 |
| variant_4296 | KKKLFKKIPPKFLKLAKKF | seqid_3244 |
| variant_4297 | RKKLFKKIPPKFLKLAKKF | seqid_3245 |
| variant_4298 | FKKLFKKIPPKFLKLAKKF | seqid_3246 |
| variant_4299 | KWKLFKKIPPKFLKLAKKF | seqid_3247 |
| variant_4300 | RWKLFKKIPPKFLKLAKKF | seqid_3248 |
| variant_4301 | FWKLFKKIPPKFLKLAKKF | seqid_3249 |
| variant_4302 | KKKKFKKIPPKFLKLAKKF | seqid_3250 |
| variant_4303 | RKKKFKKIPPKFLKLAKKF | seqid_3251 |
| variant_4304 | FKKKFKKIPPKFLKLAKKF | seqid_3252 |
| variant_4305 | KWKKFKKIPPKFLKLAKKF | seqid_3253 |
| variant_4306 | RWKKFKKIPPKFLKLAKKF | seqid_3254 |
| variant_4307 | FWKKFKKIPPKFLKLAKKF | seqid_3255 |
| variant_4308 | KKKLLKKIPPKFLKLAKKF | seqid_3256 |
| variant_4309 | RKKLLKKIPPKFLKLAKKF | seqid_3257 |
| variant_4310 | FKKLLKKIPPKFLKLAKKF | seqid_3258 |
| variant_4311 | KWKLLKKIPPKFLKLAKKF | seqid_3259 |
| variant_4312 | RWKLLKKIPPKFLKLAKKF | seqid_3260 |
| variant_4313 | FWKLLKKIPPKFLKLAKKF | seqid_3261 |
| variant_4314 | KKKKLKKIPPKFLKLAKKF | seqid_3262 |
| variant_4315 | RKKKLKKIPPKFLKLAKKF | seqid_3263 |
| variant_4316 | FKKKLKKIPPKFLKLAKKF | seqid_3264 |
| variant_4317 | KWKKLKKIPPKFLKLAKKF | seqid_3265 |
| variant_4318 | RWKKLKKIPPKFLKLAKKF | seqid_3266 |
| variant_4319 | FWKKLKKIPPKFLKLAKKF | seqid_3267 |
| variant_4368 | KKKLFLKIPKFLKLAKKF | seqid_3268 |
| variant_4369 | RKKLFLKIPKFLKLAKKF | seqid_3269 |
| variant_4370 | FKKLFLKIPKFLKLAKKF | seqid_3270 |
| variant_4371 | KWKLFLKIPKFLKLAKKF | seqid_3271 |
| variant_4372 | RWKLFLKIPKFLKLAKKF | seqid_3272 |
| variant_4373 | FWKLFLKIPKFLKLAKKF | seqid_3273 |
| variant_4374 | KKKKFLKIPKFLKLAKKF | seqid_3274 |
| variant_4375 | RKKKFLKIPKFLKLAKKF | seqid_3275 |
| variant_4376 | FKKKFLKIPKFLKLAKKF | seqid_3276 |
| variant_4377 | KWKKFLKIPKFLKLAKKF | seqid_3277 |
| variant_4378 | RWKKFLKIPKFLKLAKKF | seqid_3278 |
| variant_4379 | FWKKFLKIPKFLKLAKKF | seqid_3279 |
| variant_4380 | KKKLLLKIPKFLKLAKKF | seqid_3280 |
| variant_4381 | RKKLLLKIPKFLKLAKKF | seqid_3281 |
| variant_4382 | FKKLLLKIPKFLKLAKKF | seqid_3282 |
| variant_4383 | KWKLLLKIPKFLKLAKKF | seqid_3283 |
| variant_4384 | RWKLLLKIPKFLKLAKKF | seqid_3284 |
| variant_4385 | FWKLLLKIPKFLKLAKKF | seqid_3285 |
| variant_4386 | KKKKLLKIPKFLKLAKKF | seqid_3286 |
| variant_4387 | RKKKLLKIPKFLKLAKKF | seqid_3287 |
| variant_4388 | FKKKLLKIPKFLKLAKKF | seqid_3288 |
| variant_4389 | KWKKLLKIPKFLKLAKKF | seqid_3289 |
| variant_4390 | RWKKLLKIPKFLKLAKKF | seqid_3290 |
| variant_4391 | FWKKLLKIPKFLKLAKKF | seqid_3291 |
| variant_4392 | KKKLFKKIPKFLKLAKKF | seqid_3292 |
| variant_4393 | RKKLFKKIPKFLKLAKKF | seqid_3293 |
| variant_4394 | FKKLFKKIPKFLKLAKKF | seqid_3294 |
| variant_4395 | KWKLFKKIPKFLKLAKKF | seqid_3295 |
| variant_4396 | RWKLFKKIPKFLKLAKKF | seqid_3296 |
| variant_4397 | FWKLFKKIPKFLKLAKKF | seqid_3297 |
| variant_4398 | KKKKFKKIPKFLKLAKKF | seqid_3298 |
| variant_4399 | RKKKFKKIPKFLKLAKKF | seqid_3299 |
| variant_4400 | FKKKFKKIPKFLKLAKKF | seqid_3300 |
| variant_4401 | KWKKFKKIPKFLKLAKKF | seqid_3301 |
| variant_4402 | RWKKFKKIPKFLKLAKKF | seqid_3302 |
| variant_4403 | FWKKFKKIPKFLKLAKKF | seqid_3303 |
| variant_4404 | KKKLLKKIPKFLKLAKKF | seqid_3304 |
| variant_4405 | RKKLLKKIPKFLKLAKKF | seqid_3305 |
| variant_4406 | FKKLLKKIPKFLKLAKKF | seqid_3306 |
| variant_4407 | KWKLLKKIPKFLKLAKKF | seqid_3307 |
| variant_4408 | RWKLLKKIPKFLKLAKKF | seqid_3308 |

| | | |
|---|---|---|
| variant_4409 | FWKLLKKIPKFLKLAKKF | seqid_3309 |
| variant_4410 | KKKKLKKIPKFLKLAKKF | seqid_3310 |
| variant_4411 | RKKKLKKIPKFLKLAKKF | seqid_3311 |
| variant_4412 | FKKKLKKIPKFLKLAKKF | seqid_3312 |
| variant_4413 | KWKKLKKIPKFLKLAKKF | seqid_3313 |
| variant_4414 | RWKKLKKIPKFLKLAKKF | seqid_3314 |
| variant_4415 | FWKKLKKIPKFLKLAKKF | seqid_3315 |
| variant_4416 | KKKLFLKIPPPKFKKLAKKF | seqid_3316 |
| variant_4417 | RKKLFLKIPPPKFKKLAKKF | seqid_3317 |
| variant_4418 | FKKLFLKIPPPKFKKLAKKF | seqid_3318 |
| variant_4419 | KWKLFLKIPPPKFKKLAKKF | seqid_3319 |
| variant_4420 | RWKLFLKIPPPKFKKLAKKF | seqid_3320 |
| variant_4421 | FWKLFLKIPPPKFKKLAKKF | seqid_3321 |
| variant_4422 | KKKKFLKIPPPKFKKLAKKF | seqid_3322 |
| variant_4423 | RKKKFLKIPPPKFKKLAKKF | seqid_3323 |
| variant_4424 | FKKKFLKIPPPKFKKLAKKF | seqid_3324 |
| variant_4425 | KWKKFLKIPPPKFKKLAKKF | seqid_3325 |
| variant_4426 | RWKKFLKIPPPKFKKLAKKF | seqid_3326 |
| variant_4427 | FWKKFLKIPPPKFKKLAKKF | seqid_3327 |
| variant_4428 | KKKLLLKIPPPKFKKLAKKF | seqid_3328 |
| variant_4429 | RKKLLLKIPPPKFKKLAKKF | seqid_3329 |
| variant_4430 | FKKLLLKIPPPKFKKLAKKF | seqid_3330 |
| variant_4431 | KWKLLLKIPPPKFKKLAKKF | seqid_3331 |
| variant_4432 | RWKLLLKIPPPKFKKLAKKF | seqid_3332 |
| variant_4433 | FWKLLLKIPPPKFKKLAKKF | seqid_3333 |
| variant_4434 | KKKKLLKIPPPKFKKLAKKF | seqid_3334 |
| variant_4435 | RKKKLLKIPPPKFKKLAKKF | seqid_3335 |
| variant_4436 | FKKKLLKIPPPKFKKLAKKF | seqid_3336 |
| variant_4437 | KWKKLLKIPPPKFKKLAKKF | seqid_3337 |
| variant_4438 | RWKKLLKIPPPKFKKLAKKF | seqid_3338 |
| variant_4439 | FWKKLLKIPPPKFKKLAKKF | seqid_3339 |
| variant_4440 | KKKLFKKIPPPKFKKLAKKF | seqid_3340 |
| variant_4441 | RKKLFKKIPPPKFKKLAKKF | seqid_3341 |
| variant_4442 | FKKLFKKIPPPKFKKLAKKF | seqid_3342 |
| variant_4443 | KWKLFKKIPPPKFKKLAKKF | seqid_3343 |
| variant_4444 | RWKLFKKIPPPKFKKLAKKF | seqid_3344 |
| variant_4445 | FWKLFKKIPPPKFKKLAKKF | seqid_3345 |
| variant_4446 | KKKKFKKIPPPKFKKLAKKF | seqid_3346 |
| variant_4447 | RKKKFKKIPPPKFKKLAKKF | seqid_3347 |
| variant_4448 | FKKKFKKIPPPKFKKLAKKF | seqid_3348 |
| variant_4449 | KWKKFKKIPPPKFKKLAKKF | seqid_3349 |
| variant_4450 | RWKKFKKIPPPKFKKLAKKF | seqid_3350 |
| variant_4451 | FWKKFKKIPPPKFKKLAKKF | seqid_3351 |
| variant_4452 | KKKLLKKIPPPKFKKLAKKF | seqid_3352 |
| variant_4453 | RKKLLKKIPPPKFKKLAKKF | seqid_3353 |
| variant_4454 | FKKLLKKIPPPKFKKLAKKF | seqid_3354 |
| variant_4455 | KWKLLKKIPPPKFKKLAKKF | seqid_3355 |
| variant_4456 | RWKLLKKIPPPKFKKLAKKF | seqid_3356 |
| variant_4457 | FWKLLKKIPPPKFKKLAKKF | seqid_3357 |
| variant_4458 | KKKKLKKIPPPKFKKLAKKF | seqid_3358 |
| variant_4459 | RKKKLKKIPPPKFKKLAKKF | seqid_3359 |
| variant_4460 | FKKKLKKIPPPKFKKLAKKF | seqid_3360 |
| variant_4461 | KWKKLKKIPPPKFKKLAKKF | seqid_3361 |
| variant_4462 | RWKKLKKIPPPKFKKLAKKF | seqid_3362 |
| variant_4463 | FWKKLKKIPPPKFKKLAKKF | seqid_3363 |
| variant_4464 | KKKLFLKIPPKFKKLAKKF | seqid_3364 |
| variant_4465 | RKKLFLKIPPKFKKLAKKF | seqid_3365 |
| variant_4466 | FKKLFLKIPPKFKKLAKKF | seqid_3366 |
| variant_4467 | KWKLFLKIPPKFKKLAKKF | seqid_3367 |
| variant_4468 | RWKLFLKIPPKFKKLAKKF | seqid_3368 |
| variant_4469 | FWKLFLKIPPKFKKLAKKF | seqid_3369 |
| variant_4470 | KKKKFLKIPPKFKKLAKKF | seqid_3370 |
| variant_4471 | RKKKFLKIPPKFKKLAKKF | seqid_3371 |
| variant_4472 | FKKKFLKIPPKFKKLAKKF | seqid_3372 |
| variant_4473 | KWKKFLKIPPKFKKLAKKF | seqid_3373 |
| variant_4474 | RWKKFLKIPPKFKKLAKKF | seqid_3374 |
| variant_4475 | FWKKFLKIPPKFKKLAKKF | seqid_3375 |
| variant_4476 | KKKLLLKIPPKFKKLAKKF | seqid_3376 |
| variant_4477 | RKKLLLKIPPKFKKLAKKF | seqid_3377 |
| variant_4478 | FKKLLLKIPPKFKKLAKKF | seqid_3378 |
| variant_4479 | KWKLLLKIPPKFKKLAKKF | seqid_3379 |
| variant_4480 | RWKLLLKIPPKFKKLAKKF | seqid_3380 |
| variant_4481 | FWKLLLKIPPKFKKLAKKF | seqid_3381 |
| variant_4482 | KKKKLLKIPPKFKKLAKKF | seqid_3382 |
| variant_4483 | RKKKLLKIPPKFKKLAKKF | seqid_3383 |
| variant_4484 | FKKKLLKIPPKFKKLAKKF | seqid_3384 |
| variant_4485 | KWKKLLKIPPKFKKLAKKF | seqid_3385 |
| variant_4486 | RWKKLLKIPPKFKKLAKKF | seqid_3386 |
| variant_4487 | FWKKLLKIPPKFKKLAKKF | seqid_3387 |
| variant_4488 | KKKLFKKIPPKFKKLAKKF | seqid_3388 |
| variant_4489 | RKKLFKKIPPKFKKLAKKF | seqid_3389 |

| | | |
|---|---|---|
| variant_4490 | FKKLFKKIPPKFKKLAKKF | seqid_3390 |
| variant_4491 | KWKLFKKIPPKFKKLAKKF | seqid_3391 |
| variant_4492 | RWKLFKKIPPKFKKLAKKF | seqid_3392 |
| variant_4493 | FWKLFKKIPPKFKKLAKKF | seqid_3393 |
| variant_4494 | KKKKFKKIPPKFKKLAKKF | seqid_3394 |
| variant_4495 | RKKKFKKIPPKFKKLAKKF | seqid_3395 |
| variant_4496 | FKKKFKKIPPKFKKLAKKF | seqid_3396 |
| variant_4497 | KWKKFKKIPPKFKKLAKKF | seqid_3397 |
| variant_4498 | RWKKFKKIPPKFKKLAKKF | seqid_3398 |
| variant_4499 | FWKKFKKIPPKFKKLAKKF | seqid_3399 |
| variant_4500 | KKKLLKKIPPKFKKLAKKF | seqid_3400 |
| variant_4501 | RKKLLKKIPPKFKKLAKKF | seqid_3401 |
| variant_4502 | FKKLLKKIPPKFKKLAKKF | seqid_3402 |
| variant_4503 | KWKLLKKIPPKFKKLAKKF | seqid_3403 |
| variant_4504 | RWKLLKKIPPKFKKLAKKF | seqid_3404 |
| variant_4505 | FWKLLKKIPPKFKKLAKKF | seqid_3405 |
| variant_4506 | KKKKLKKIPPKFKKLAKKF | seqid_3406 |
| variant_4507 | RKKKLKKIPPKFKKLAKKF | seqid_3407 |
| variant_4508 | FKKKLKKIPPKFKKLAKKF | seqid_3408 |
| variant_4509 | KWKKLKKIPPKFKKLAKKF | seqid_3409 |
| variant_4510 | RWKKLKKIPPKFKKLAKKF | seqid_3410 |
| variant_4511 | FWKKLKKIPPKFKKLAKKF | seqid_3411 |
| variant_4560 | KKKLFLKIPKFKKLAKKF | seqid_3412 |
| variant_4561 | RKKLFLKIPKFKKLAKKF | seqid_3413 |
| variant_4562 | FKKLFLKIPKFKKLAKKF | seqid_3414 |
| variant_4563 | KWKLFLKIPKFKKLAKKF | seqid_3415 |
| variant_4564 | RWKLFLKIPKFKKLAKKF | seqid_3416 |
| variant_4565 | FWKLFLKIPKFKKLAKKF | seqid_3417 |
| variant_4566 | KKKKFLKIPKFKKLAKKF | seqid_3418 |
| variant_4567 | RKKKFLKIPKFKKLAKKF | seqid_3419 |
| variant_4568 | FKKKFLKIPKFKKLAKKF | seqid_3420 |
| variant_4569 | KWKKFLKIPKFKKLAKKF | seqid_3421 |
| variant_4570 | RWKKFLKIPKFKKLAKKF | seqid_3422 |
| variant_4571 | FWKKFLKIPKFKKLAKKF | seqid_3423 |
| variant_4572 | KKKLLLKIPKFKKLAKKF | seqid_3424 |
| variant_4573 | RKKLLLKIPKFKKLAKKF | seqid_3425 |
| variant_4574 | FKKLLLKIPKFKKLAKKF | seqid_3426 |
| variant_4575 | KWKLLLKIPKFKKLAKKF | seqid_3427 |
| variant_4576 | RWKLLLKIPKFKKLAKKF | seqid_3428 |
| variant_4577 | FWKLLLKIPKFKKLAKKF | seqid_3429 |
| variant_4578 | KKKKLLKIPKFKKLAKKF | seqid_3430 |
| variant_4579 | RKKKLLKIPKFKKLAKKF | seqid_3431 |
| variant_4580 | FKKKLLKIPKFKKLAKKF | seqid_3432 |
| variant_4581 | KWKKLLKIPKFKKLAKKF | seqid_3433 |
| variant_4582 | RWKKLLKIPKFKKLAKKF | seqid_3434 |
| variant_4583 | FWKKLLKIPKFKKLAKKF | seqid_3435 |
| variant_4584 | KKKLFKKIPKFKKLAKKF | seqid_3436 |
| variant_4585 | RKKLFKKIPKFKKLAKKF | seqid_3437 |
| variant_4586 | FKKLFKKIPKFKKLAKKF | seqid_3438 |
| variant_4587 | KWKLFKKIPKFKKLAKKF | seqid_3439 |
| variant_4588 | RWKLFKKIPKFKKLAKKF | seqid_3440 |
| variant_4589 | FWKLFKKIPKFKKLAKKF | seqid_3441 |
| variant_4590 | KKKKFKKIPKFKKLAKKF | seqid_3442 |
| variant_4591 | RKKKFKKIPKFKKLAKKF | seqid_3443 |
| variant_4592 | FKKKFKKIPKFKKLAKKF | seqid_3444 |
| variant_4593 | KWKKFKKIPKFKKLAKKF | seqid_3445 |
| variant_4594 | RWKKFKKIPKFKKLAKKF | seqid_3446 |
| variant_4595 | FWKKFKKIPKFKKLAKKF | seqid_3447 |
| variant_4596 | KKKLLKKIPKFKKLAKKF | seqid_3448 |
| variant_4597 | RKKLLKKIPKFKKLAKKF | seqid_3449 |
| variant_4598 | FKKLLKKIPKFKKLAKKF | seqid_3450 |
| variant_4599 | KWKLLKKIPKFKKLAKKF | seqid_3451 |
| variant_4600 | RWKLLKKIPKFKKLAKKF | seqid_3452 |
| variant_4601 | FWKLLKKIPKFKKLAKKF | seqid_3453 |
| variant_4602 | KKKKLKKIPKFKKLAKKF | seqid_3454 |
| variant_4603 | RKKKLKKIPKFKKLAKKF | seqid_3455 |
| variant_4604 | FKKKLKKIPKFKKLAKKF | seqid_3456 |
| variant_4605 | KWKKLKKIPKFKKLAKKF | seqid_3457 |
| variant_4606 | RWKKLKKIPKFKKLAKKF | seqid_3458 |
| variant_4607 | FWKKLKKIPKFKKLAKKF | seqid_3459 |
| variant_4608 | KKKLFLKIPPPKFLHVAKKF | seqid_3460 |
| variant_4609 | RKKLFLKIPPPKFLHVAKKF | seqid_3461 |
| variant_4610 | FKKLFLKIPPPKFLHVAKKF | seqid_3462 |
| variant_4611 | KWKLFLKIPPPKFLHVAKKF | seqid_3463 |
| variant_4612 | RWKLFLKIPPPKFLHVAKKF | seqid_3464 |
| variant_4613 | FWKLFLKIPPPKFLHVAKKF | seqid_3465 |
| variant_4614 | KKKKFLKIPPPKFLHVAKKF | seqid_3466 |
| variant_4615 | RKKKFLKIPPPKFLHVAKKF | seqid_3467 |
| variant_4616 | FKKKFLKIPPPKFLHVAKKF | seqid_3468 |
| variant_4617 | KWKKFLKIPPPKFLHVAKKF | seqid_3469 |
| variant_4618 | RWKKFLKIPPPKFLHVAKKF | seqid_3470 |

| variant_4619 | FWKKFLKIPPPKFLHVAKKF | seqid_3471 |
| variant_4620 | KKKLLLKIPPPKFLHVAKKF | seqid_3472 |
| variant_4621 | RKKLLLKIPPPKFLHVAKKF | seqid_3473 |
| variant_4622 | FKKLLLKIPPPKFLHVAKKF | seqid_3474 |
| variant_4623 | KWKLLLKIPPPKFLHVAKKF | seqid_3475 |
| variant_4624 | RWKLLLKIPPPKFLHVAKKF | seqid_3476 |
| variant_4625 | FWKLLLKIPPPKFLHVAKKF | seqid_3477 |
| variant_4626 | KKKKLLKIPPPKFLHVAKKF | seqid_3478 |
| variant_4627 | RKKKLLKIPPPKFLHVAKKF | seqid_3479 |
| variant_4628 | FKKKLLKIPPPKFLHVAKKF | seqid_3480 |
| variant_4629 | KWKKLLKIPPPKFLHVAKKF | seqid_3481 |
| variant_4630 | RWKKLLKIPPPKFLHVAKKF | seqid_3482 |
| variant_4631 | FWKKLLKIPPPKFLHVAKKF | seqid_3483 |
| variant_4632 | KKKLFKKIPPPKFLHVAKKF | seqid_3484 |
| variant_4633 | RKKLFKKIPPPKFLHVAKKF | seqid_3485 |
| variant_4634 | FKKLFKKIPPPKFLHVAKKF | seqid_3486 |
| variant_4635 | KWKLFKKIPPPKFLHVAKKF | seqid_3487 |
| variant_4636 | RWKLFKKIPPPKFLHVAKKF | seqid_3488 |
| variant_4637 | FWKLFKKIPPPKFLHVAKKF | seqid_3489 |
| variant_4638 | KKKKFKKIPPPKFLHVAKKF | seqid_3490 |
| variant_4639 | RKKKFKKIPPPKFLHVAKKF | seqid_3491 |
| variant_4640 | FKKKFKKIPPPKFLHVAKKF | seqid_3492 |
| variant_4641 | KWKKFKKIPPPKFLHVAKKF | seqid_3493 |
| variant_4642 | RWKKFKKIPPPKFLHVAKKF | seqid_3494 |
| variant_4643 | FWKKFKKIPPPKFLHVAKKF | seqid_3495 |
| variant_4644 | KKKLLKKIPPPKFLHVAKKF | seqid_3496 |
| variant_4645 | RKKLLKKIPPPKFLHVAKKF | seqid_3497 |
| variant_4646 | FKKLLKKIPPPKFLHVAKKF | seqid_3498 |
| variant_4647 | KWKLLKKIPPPKFLHVAKKF | seqid_3499 |
| variant_4648 | RWKLLKKIPPPKFLHVAKKF | seqid_3500 |
| variant_4649 | FWKLLKKIPPPKFLHVAKKF | seqid_3501 |
| variant_4650 | KKKKLKKIPPPKFLHVAKKF | seqid_3502 |
| variant_4651 | RKKKLKKIPPPKFLHVAKKF | seqid_3503 |
| variant_4652 | FKKKLKKIPPPKFLHVAKKF | seqid_3504 |
| variant_4653 | KWKKLKKIPPPKFLHVAKKF | seqid_3505 |
| variant_4654 | RWKKLKKIPPPKFLHVAKKF | seqid_3506 |
| variant_4655 | FWKKLKKIPPPKFLHVAKKF | seqid_3507 |
| variant_4656 | KKKLFLKIPPKFLHVAKKF | seqid_3508 |
| variant_4657 | RKKLFLKIPPKFLHVAKKF | seqid_3509 |
| variant_4658 | FKKLFLKIPPKFLHVAKKF | seqid_3510 |
| variant_4659 | KWKLFLKIPPKFLHVAKKF | seqid_3511 |
| variant_4660 | RWKLFLKIPPKFLHVAKKF | seqid_3512 |
| variant_4661 | FWKLFLKIPPKFLHVAKKF | seqid_3513 |
| variant_4662 | KKKKFLKIPPKFLHVAKKF | seqid_3514 |
| variant_4663 | RKKKFLKIPPKFLHVAKKF | seqid_3515 |
| variant_4664 | FKKKFLKIPPKFLHVAKKF | seqid_3516 |
| variant_4665 | KWKKFLKIPPKFLHVAKKF | seqid_3517 |
| variant_4666 | RWKKFLKIPPKFLHVAKKF | seqid_3518 |
| variant_4667 | FWKKFLKIPPKFLHVAKKF | seqid_3519 |
| variant_4668 | KKKLLLKIPPKFLHVAKKF | seqid_3520 |
| variant_4669 | RKKLLLKIPPKFLHVAKKF | seqid_3521 |
| variant_4670 | FKKLLLKIPPKFLHVAKKF | seqid_3522 |
| variant_4671 | KWKLLLKIPPKFLHVAKKF | seqid_3523 |
| variant_4672 | RWKLLLKIPPKFLHVAKKF | seqid_3524 |
| variant_4673 | FWKLLLKIPPKFLHVAKKF | seqid_3525 |
| variant_4674 | KKKKLLKIPPKFLHVAKKF | seqid_3526 |
| variant_4675 | RKKKLLKIPPKFLHVAKKF | seqid_3527 |
| variant_4676 | FKKKLLKIPPKFLHVAKKF | seqid_3528 |
| variant_4677 | KWKKLLKIPPKFLHVAKKF | seqid_3529 |
| variant_4678 | RWKKLLKIPPKFLHVAKKF | seqid_3530 |
| variant_4679 | FWKKLLKIPPKFLHVAKKF | seqid_3531 |
| variant_4680 | KKKLFKKIPPKFLHVAKKF | seqid_3532 |
| variant_4681 | RKKLFKKIPPKFLHVAKKF | seqid_3533 |
| variant_4682 | FKKLFKKIPPKFLHVAKKF | seqid_3534 |
| variant_4683 | KWKLFKKIPPKFLHVAKKF | seqid_3535 |
| variant_4684 | RWKLFKKIPPKFLHVAKKF | seqid_3536 |
| variant_4685 | FWKLFKKIPPKFLHVAKKF | seqid_3537 |
| variant_4686 | KKKKFKKIPPKFLHVAKKF | seqid_3538 |
| variant_4687 | RKKKFKKIPPKFLHVAKKF | seqid_3539 |
| variant_4688 | FKKKFKKIPPKFLHVAKKF | seqid_3540 |
| variant_4689 | KWKKFKKIPPKFLHVAKKF | seqid_3541 |
| variant_4690 | RWKKFKKIPPKFLHVAKKF | seqid_3542 |
| variant_4691 | FWKKFKKIPPKFLHVAKKF | seqid_3543 |
| variant_4692 | KKKLLKKIPPKFLHVAKKF | seqid_3544 |
| variant_4693 | RKKLLKKIPPKFLHVAKKF | seqid_3545 |
| variant_4694 | FKKLLKKIPPKFLHVAKKF | seqid_3546 |
| variant_4695 | KWKLLKKIPPKFLHVAKKF | seqid_3547 |
| variant_4696 | RWKLLKKIPPKFLHVAKKF | seqid_3548 |
| variant_4697 | FWKLLKKIPPKFLHVAKKF | seqid_3549 |
| variant_4698 | KKKKLKKIPPKFLHVAKKF | seqid_3550 |
| variant_4699 | RKKKLKKIPPKFLHVAKKF | seqid_3551 |

| variant_4700 | FKKKLKKIPPKFLHVAKKF | seqid_3552 |
| variant_4701 | KWKKLKKIPPKFLHVAKKF | seqid_3553 |
| variant_4702 | RWKKLKKIPPKFLHVAKKF | seqid_3554 |
| variant_4703 | FWKKLKKIPPKFLHVAKKF | seqid_3555 |
| variant_4752 | KKKLFLKIPKFLHVAKKF | seqid_3556 |
| variant_4753 | RKKLFLKIPKFLHVAKKF | seqid_3557 |
| variant_4754 | FKKLFLKIPKFLHVAKKF | seqid_3558 |
| variant_4755 | KWKLFLKIPKFLHVAKKF | seqid_3559 |
| variant_4756 | RWKLFLKIPKFLHVAKKF | seqid_3560 |
| variant_4757 | FWKLFLKIPKFLHVAKKF | seqid_3561 |
| variant_4758 | KKKKFLKIPKFLHVAKKF | seqid_3562 |
| variant_4759 | RKKKFLKIPKFLHVAKKF | seqid_3563 |
| variant_4760 | FKKKFLKIPKFLHVAKKF | seqid_3564 |
| variant_4761 | KWKKFLKIPKFLHVAKKF | seqid_3565 |
| variant_4762 | RWKKFLKIPKFLHVAKKF | seqid_3566 |
| variant_4763 | FWKKFLKIPKFLHVAKKF | seqid_3567 |
| variant_4764 | KKKLLLKIPKFLHVAKKF | seqid_3568 |
| variant_4765 | RKKLLLKIPKFLHVAKKF | seqid_3569 |
| variant_4766 | FKKLLLKIPKFLHVAKKF | seqid_3570 |
| variant_4767 | KWKLLLKIPKFLHVAKKF | seqid_3571 |
| variant_4768 | RWKLLLKIPKFLHVAKKF | seqid_3572 |
| variant_4769 | FWKLLLKIPKFLHVAKKF | seqid_3573 |
| variant_4770 | KKKKLLKIPKFLHVAKKF | seqid_3574 |
| variant_4771 | RKKKLLKIPKFLHVAKKF | seqid_3575 |
| variant_4772 | FKKKLLKIPKFLHVAKKF | seqid_3576 |
| variant_4773 | KWKKLLKIPKFLHVAKKF | seqid_3577 |
| variant_4774 | RWKKLLKIPKFLHVAKKF | seqid_3578 |
| variant_4775 | FWKKLLKIPKFLHVAKKF | seqid_3579 |
| variant_4776 | KKKLFKKIPKFLHVAKKF | seqid_3580 |
| variant_4777 | RKKLFKKIPKFLHVAKKF | seqid_3581 |
| variant_4778 | FKKLFKKIPKFLHVAKKF | seqid_3582 |
| variant_4779 | KWKLFKKIPKFLHVAKKF | seqid_3583 |
| variant_4780 | RWKLFKKIPKFLHVAKKF | seqid_3584 |
| variant_4781 | FWKLFKKIPKFLHVAKKF | seqid_3585 |
| variant_4782 | KKKKFKKIPKFLHVAKKF | seqid_3586 |
| variant_4783 | RKKKFKKIPKFLHVAKKF | seqid_3587 |
| variant_4784 | FKKKFKKIPKFLHVAKKF | seqid_3588 |
| variant_4785 | KWKKFKKIPKFLHVAKKF | seqid_3589 |
| variant_4786 | RWKKFKKIPKFLHVAKKF | seqid_3590 |
| variant_4787 | FWKKFKKIPKFLHVAKKF | seqid_3591 |
| variant_4788 | KKKLLKKIPKFLHVAKKF | seqid_3592 |
| variant_4789 | RKKLLKKIPKFLHVAKKF | seqid_3593 |
| variant_4790 | FKKLLKKIPKFLHVAKKF | seqid_3594 |
| variant_4791 | KWKLLKKIPKFLHVAKKF | seqid_3595 |
| variant_4792 | RWKLLKKIPKFLHVAKKF | seqid_3596 |
| variant_4793 | FWKLLKKIPKFLHVAKKF | seqid_3597 |
| variant_4794 | KKKKLKKIPKFLHVAKKF | seqid_3598 |
| variant_4795 | RKKKLKKIPKFLHVAKKF | seqid_3599 |
| variant_4796 | FKKKLKKIPKFLHVAKKF | seqid_3600 |
| variant_4797 | KWKKLKKIPKFLHVAKKF | seqid_3601 |
| variant_4798 | RWKKLKKIPKFLHVAKKF | seqid_3602 |
| variant_4799 | FWKKLKKIPKFLHVAKKF | seqid_3603 |
| variant_4800 | KKKLFLKIPPPKFKHVAKKF | seqid_3604 |
| variant_4801 | RKKLFLKIPPPKFKHVAKKF | seqid_3605 |
| variant_4802 | FKKLFLKIPPPKFKHVAKKF | seqid_3606 |
| variant_4803 | KWKLFLKIPPPKFKHVAKKF | seqid_3607 |
| variant_4804 | RWKLFLKIPPPKFKHVAKKF | seqid_3608 |
| variant_4805 | FWKLFLKIPPPKFKHVAKKF | seqid_3609 |
| variant_4806 | KKKKFLKIPPPKFKHVAKKF | seqid_3610 |
| variant_4807 | RKKKFLKIPPPKFKHVAKKF | seqid_3611 |
| variant_4808 | FKKKFLKIPPPKFKHVAKKF | seqid_3612 |
| variant_4809 | KWKKFLKIPPPKFKHVAKKF | seqid_3613 |
| variant_4810 | RWKKFLKIPPPKFKHVAKKF | seqid_3614 |
| variant_4811 | FWKKFLKIPPPKFKHVAKKF | seqid_3615 |
| variant_4812 | KKKLLLKIPPPKFKHVAKKF | seqid_3616 |
| variant_4813 | RKKLLLKIPPPKFKHVAKKF | seqid_3617 |
| variant_4814 | FKKLLLKIPPPKFKHVAKKF | seqid_3618 |
| variant_4815 | KWKLLLKIPPPKFKHVAKKF | seqid_3619 |
| variant_4816 | RWKLLLKIPPPKFKHVAKKF | seqid_3620 |
| variant_4817 | FWKLLLKIPPPKFKHVAKKF | seqid_3621 |
| variant_4818 | KKKKLLKIPPPKFKHVAKKF | seqid_3622 |
| variant_4819 | RKKKLLKIPPPKFKHVAKKF | seqid_3623 |
| variant_4820 | FKKKLLKIPPPKFKHVAKKF | seqid_3624 |
| variant_4821 | KWKKLLKIPPPKFKHVAKKF | seqid_3625 |
| variant_4822 | RWKKLLKIPPPKFKHVAKKF | seqid_3626 |
| variant_4823 | FWKKLLKIPPPKFKHVAKKF | seqid_3627 |
| variant_4824 | KKKLFKKIPPPKFKHVAKKF | seqid_3628 |
| variant_4825 | RKKLFKKIPPPKFKHVAKKF | seqid_3629 |
| variant_4826 | FKKLFKKIPPPKFKHVAKKF | seqid_3630 |
| variant_4827 | KWKLFKKIPPPKFKHVAKKF | seqid_3631 |
| variant_4828 | RWKLFKKIPPPKFKHVAKKF | seqid_3632 |

| | | |
|---|---|---|
| variant_4829 | FWKLFKKIPPPKFKHVAKKF | seqid_3633 |
| variant_4830 | KKKKFKKIPPPKFKHVAKKF | seqid_3634 |
| variant_4831 | RKKKFKKIPPPKFKHVAKKF | seqid_3635 |
| variant_4832 | FKKKFKKIPPPKFKHVAKKF | seqid_3636 |
| variant_4833 | KWKKFKKIPPPKFKHVAKKF | seqid_3637 |
| variant_4834 | RWKKFKKIPPPKFKHVAKKF | seqid_3638 |
| variant_4835 | FWKKFKKIPPPKFKHVAKKF | seqid_3639 |
| variant_4836 | KKKLLKKIPPPKFKHVAKKF | seqid_3640 |
| variant_4837 | RKKLLKKIPPPKFKHVAKKF | seqid_3641 |
| variant_4838 | FKKLLKKIPPPKFKHVAKKF | seqid_3642 |
| variant_4839 | KWKLLKKIPPPKFKHVAKKF | seqid_3643 |
| variant_4840 | RWKLLKKIPPPKFKHVAKKF | seqid_3644 |
| variant_4841 | FWKLLKKIPPPKFKHVAKKF | seqid_3645 |
| variant_4842 | KKKKLKKIPPPKFKHVAKKF | seqid_3646 |
| variant_4843 | RKKKLKKIPPPKFKHVAKKF | seqid_3647 |
| variant_4844 | FKKKLKKIPPPKFKHVAKKF | seqid_3648 |
| variant_4845 | KWKKLKKIPPPKFKHVAKKF | seqid_3649 |
| variant_4846 | RWKKLKKIPPPKFKHVAKKF | seqid_3650 |
| variant_4847 | FWKKLKKIPPPKFKHVAKKF | seqid_3651 |
| variant_4848 | KKKLFLKIPPKFKHVAKKF | seqid_3652 |
| variant_4849 | RKKLFLKIPPKFKHVAKKF | seqid_3653 |
| variant_4850 | FKKLFLKIPPKFKHVAKKF | seqid_3654 |
| variant_4851 | KWKLFLKIPPKFKHVAKKF | seqid_3655 |
| variant_4852 | RWKLFLKIPPKFKHVAKKF | seqid_3656 |
| variant_4853 | FWKLFLKIPPKFKHVAKKF | seqid_3657 |
| variant_4854 | KKKKFLKIPPKFKHVAKKF | seqid_3658 |
| variant_4855 | RKKKFLKIPPKFKHVAKKF | seqid_3659 |
| variant_4856 | FKKKFLKIPPKFKHVAKKF | seqid_3660 |
| variant_4857 | KWKKFLKIPPKFKHVAKKF | seqid_3661 |
| variant_4858 | RWKKFLKIPPKFKHVAKKF | seqid_3662 |
| variant_4859 | FWKKFLKIPPKFKHVAKKF | seqid_3663 |
| variant_4860 | KKKLLLKIPPKFKHVAKKF | seqid_3664 |
| variant_4861 | RKKLLLKIPPKFKHVAKKF | seqid_3665 |
| variant_4862 | FKKLLLKIPPKFKHVAKKF | seqid_3666 |
| variant_4863 | KWKLLLKIPPKFKHVAKKF | seqid_3667 |
| variant_4864 | RWKLLLKIPPKFKHVAKKF | seqid_3668 |
| variant_4865 | FWKLLLKIPPKFKHVAKKF | seqid_3669 |
| variant_4866 | KKKKLLKIPPKFKHVAKKF | seqid_3670 |
| variant_4867 | RKKKLLKIPPKFKHVAKKF | seqid_3671 |
| variant_4868 | FKKKLLKIPPKFKHVAKKF | seqid_3672 |
| variant_4869 | KWKKLLKIPPKFKHVAKKF | seqid_3673 |
| variant_4870 | RWKKLLKIPPKFKHVAKKF | seqid_3674 |
| variant_4871 | FWKKLLKIPPKFKHVAKKF | seqid_3675 |
| variant_4872 | KKKLFKKIPPKFKHVAKKF | seqid_3676 |
| variant_4873 | RKKLFKKIPPKFKHVAKKF | seqid_3677 |
| variant_4874 | FKKLFKKIPPKFKHVAKKF | seqid_3678 |
| variant_4875 | KWKLFKKIPPKFKHVAKKF | seqid_3679 |
| variant_4876 | RWKLFKKIPPKFKHVAKKF | seqid_3680 |
| variant_4877 | FWKLFKKIPPKFKHVAKKF | seqid_3681 |
| variant_4878 | KKKKFKKIPPKFKHVAKKF | seqid_3682 |
| variant_4879 | RKKKFKKIPPKFKHVAKKF | seqid_3683 |
| variant_4880 | FKKKFKKIPPKFKHVAKKF | seqid_3684 |
| variant_4881 | KWKKFKKIPPKFKHVAKKF | seqid_3685 |
| variant_4882 | RWKKFKKIPPKFKHVAKKF | seqid_3686 |
| variant_4883 | FWKKFKKIPPKFKHVAKKF | seqid_3687 |
| variant_4884 | KKKLLKKIPPKFKHVAKKF | seqid_3688 |
| variant_4885 | RKKLLKKIPPKFKHVAKKF | seqid_3689 |
| variant_4886 | FKKLLKKIPPKFKHVAKKF | seqid_3690 |
| variant_4887 | KWKLLKKIPPKFKHVAKKF | seqid_3691 |
| variant_4888 | RWKLLKKIPPKFKHVAKKF | seqid_3692 |
| variant_4889 | FWKLLKKIPPKFKHVAKKF | seqid_3693 |
| variant_4890 | KKKKLKKIPPKFKHVAKKF | seqid_3694 |
| variant_4891 | RKKKLKKIPPKFKHVAKKF | seqid_3695 |
| variant_4892 | FKKKLKKIPPKFKHVAKKF | seqid_3696 |
| variant_4893 | KWKKLKKIPPKFKHVAKKF | seqid_3697 |
| variant_4894 | RWKKLKKIPPKFKHVAKKF | seqid_3698 |
| variant_4895 | FWKKLKKIPPKFKHVAKKF | seqid_3699 |
| variant_4944 | KKKLFLKIPKFKHVAKKF | seqid_3700 |
| variant_4945 | RKKLFLKIPKFKHVAKKF | seqid_3701 |
| variant_4946 | FKKLFLKIPKFKHVAKKF | seqid_3702 |
| variant_4947 | KWKLFLKIPKFKHVAKKF | seqid_3703 |
| variant_4948 | RWKLFLKIPKFKHVAKKF | seqid_3704 |
| variant_4949 | FWKLFLKIPKFKHVAKKF | seqid_3705 |
| variant_4950 | KKKKFLKIPKFKHVAKKF | seqid_3706 |
| variant_4951 | RKKKFLKIPKFKHVAKKF | seqid_3707 |
| variant_4952 | FKKKFLKIPKFKHVAKKF | seqid_3708 |
| variant_4953 | KWKKFLKIPKFKHVAKKF | seqid_3709 |
| variant_4954 | RWKKFLKIPKFKHVAKKF | seqid_3710 |
| variant_4955 | FWKKFLKIPKFKHVAKKF | seqid_3711 |
| variant_4956 | KKKLLLKIPKFKHVAKKF | seqid_3712 |
| variant_4957 | RKKLLLKIPKFKHVAKKF | seqid_3713 |

| | | |
|---|---|---|
| variant_4958 | FKKLLLKIPKFKHVAKKF | seqid_3714 |
| variant_4959 | KWKLLLKIPKFKHVAKKF | seqid_3715 |
| variant_4960 | RWKLLLKIPKFKHVAKKF | seqid_3716 |
| variant_4961 | FWKLLLKIPKFKHVAKKF | seqid_3717 |
| variant_4962 | KKKKLLKIPKFKHVAKKF | seqid_3718 |
| variant_4963 | RKKKLLKIPKFKHVAKKF | seqid_3719 |
| variant_4964 | FKKKLLKIPKFKHVAKKF | seqid_3720 |
| variant_4965 | KWKKLLKIPKFKHVAKKF | seqid_3721 |
| variant_4966 | RWKKLLKIPKFKHVAKKF | seqid_3722 |
| variant_4967 | FWKKLLKIPKFKHVAKKF | seqid_3723 |
| variant_4968 | KKKLFKKIPKFKHVAKKF | seqid_3724 |
| variant_4969 | RKKLFKKIPKFKHVAKKF | seqid_3725 |
| variant_4970 | FKKLFKKIPKFKHVAKKF | seqid_3726 |
| variant_4971 | KWKLFKKIPKFKHVAKKF | seqid_3727 |
| variant_4972 | RWKLFKKIPKFKHVAKKF | seqid_3728 |
| variant_4973 | FWKLFKKIPKFKHVAKKF | seqid_3729 |
| variant_4974 | KKKKFKKIPKFKHVAKKF | seqid_3730 |
| variant_4975 | RKKKFKKIPKFKHVAKKF | seqid_3731 |
| variant_4976 | FKKKFKKIPKFKHVAKKF | seqid_3732 |
| variant_4977 | KWKKFKKIPKFKHVAKKF | seqid_3733 |
| variant_4978 | RWKKFKKIPKFKHVAKKF | seqid_3734 |
| variant_4979 | FWKKFKKIPKFKHVAKKF | seqid_3735 |
| variant_4980 | KKKLLKKIPKFKHVAKKF | seqid_3736 |
| variant_4981 | RKKLLKKIPKFKHVAKKF | seqid_3737 |
| variant_4982 | FKKLLKKIPKFKHVAKKF | seqid_3738 |
| variant_4983 | KWKLLKKIPKFKHVAKKF | seqid_3739 |
| variant_4984 | RWKLLKKIPKFKHVAKKF | seqid_3740 |
| variant_4985 | FWKLLKKIPKFKHVAKKF | seqid_3741 |
| variant_4986 | KKKKLKKIPKFKHVAKKF | seqid_3742 |
| variant_4987 | RKKKLKKIPKFKHVAKKF | seqid_3743 |
| variant_4988 | FKKKLKKIPKFKHVAKKF | seqid_3744 |
| variant_4989 | KWKKLKKIPKFKHVAKKF | seqid_3745 |
| variant_4990 | RWKKLKKIPKFKHVAKKF | seqid_3746 |
| variant_4991 | FWKKLKKIPKFKHVAKKF | seqid_3747 |
| variant_4992 | KKKLFLKIPPPKFLKVAKKF | seqid_3748 |
| variant_4993 | RKKLFLKIPPPKFLKVAKKF | seqid_3749 |
| variant_4994 | FKKLFLKIPPPKFLKVAKKF | seqid_3750 |
| variant_4995 | KWKLFLKIPPPKFLKVAKKF | seqid_3751 |
| variant_4996 | RWKLFLKIPPPKFLKVAKKF | seqid_3752 |
| variant_4997 | FWKLFLKIPPPKFLKVAKKF | seqid_3753 |
| variant_4998 | KKKKFLKIPPPKFLKVAKKF | seqid_3754 |
| variant_4999 | RKKKFLKIPPPKFLKVAKKF | seqid_3755 |
| variant_5000 | FKKKFLKIPPPKFLKVAKKF | seqid_3756 |
| variant_5001 | KWKKFLKIPPPKFLKVAKKF | seqid_3757 |
| variant_5002 | RWKKFLKIPPPKFLKVAKKF | seqid_3758 |
| variant_5003 | FWKKFLKIPPPKFLKVAKKF | seqid_3759 |
| variant_5004 | KKKLLLKIPPPKFLKVAKKF | seqid_3760 |
| variant_5005 | RKKLLLKIPPPKFLKVAKKF | seqid_3761 |
| variant_5006 | FKKLLLKIPPPKFLKVAKKF | seqid_3762 |
| variant_5007 | KWKLLLKIPPPKFLKVAKKF | seqid_3763 |
| variant_5008 | RWKLLLKIPPPKFLKVAKKF | seqid_3764 |
| variant_5009 | FWKLLLKIPPPKFLKVAKKF | seqid_3765 |
| variant_5010 | KKKKLLKIPPPKFLKVAKKF | seqid_3766 |
| variant_5011 | RKKKLLKIPPPKFLKVAKKF | seqid_3767 |
| variant_5012 | FKKKLLKIPPPKFLKVAKKF | seqid_3768 |
| variant_5013 | KWKKLLKIPPPKFLKVAKKF | seqid_3769 |
| variant_5014 | RWKKLLKIPPPKFLKVAKKF | seqid_3770 |
| variant_5015 | FWKKLLKIPPPKFLKVAKKF | seqid_3771 |
| variant_5016 | KKKLFKKIPPPKFLKVAKKF | seqid_3772 |
| variant_5017 | RKKLFKKIPPPKFLKVAKKF | seqid_3773 |
| variant_5018 | FKKLFKKIPPPKFLKVAKKF | seqid_3774 |
| variant_5019 | KWKLFKKIPPPKFLKVAKKF | seqid_3775 |
| variant_5020 | RWKLFKKIPPPKFLKVAKKF | seqid_3776 |
| variant_5021 | FWKLFKKIPPPKFLKVAKKF | seqid_3777 |
| variant_5022 | KKKKFKKIPPPKFLKVAKKF | seqid_3778 |
| variant_5023 | RKKKFKKIPPPKFLKVAKKF | seqid_3779 |
| variant_5024 | FKKKFKKIPPPKFLKVAKKF | seqid_3780 |
| variant_5025 | KWKKFKKIPPPKFLKVAKKF | seqid_3781 |
| variant_5026 | RWKKFKKIPPPKFLKVAKKF | seqid_3782 |
| variant_5027 | FWKKFKKIPPPKFLKVAKKF | seqid_3783 |
| variant_5028 | KKKLLKKIPPPKFLKVAKKF | seqid_3784 |
| variant_5029 | RKKLLKKIPPPKFLKVAKKF | seqid_3785 |
| variant_5030 | FKKLLKKIPPPKFLKVAKKF | seqid_3786 |
| variant_5031 | KWKLLKKIPPPKFLKVAKKF | seqid_3787 |
| variant_5032 | RWKLLKKIPPPKFLKVAKKF | seqid_3788 |
| variant_5033 | FWKLLKKIPPPKFLKVAKKF | seqid_3789 |
| variant_5034 | KKKKLKKIPPPKFLKVAKKF | seqid_3790 |
| variant_5035 | RKKKLKKIPPPKFLKVAKKF | seqid_3791 |
| variant_5036 | FKKKLKKIPPPKFLKVAKKF | seqid_3792 |
| variant_5037 | KWKKLKKIPPPKFLKVAKKF | seqid_3793 |
| variant_5038 | RWKKLKKIPPPKFLKVAKKF | seqid_3794 |

| | | |
|---|---|---|
| variant_5039 | FWKKLKKIPPPKFLKVAKKF | seqid_3795 |
| variant_5040 | KKKLFLKIPPKFLKVAKKF | seqid_3796 |
| variant_5041 | RKKLFLKIPPKFLKVAKKF | seqid_3797 |
| variant_5042 | FKKLFLKIPPKFLKVAKKF | seqid_3798 |
| variant_5043 | KWKLFLKIPPKFLKVAKKF | seqid_3799 |
| variant_5044 | RWKLFLKIPPKFLKVAKKF | seqid_3800 |
| variant_5045 | FWKLFLKIPPKFLKVAKKF | seqid_3801 |
| variant_5046 | KKKKFLKIPPKFLKVAKKF | seqid_3802 |
| variant_5047 | RKKKFLKIPPKFLKVAKKF | seqid_3803 |
| variant_5048 | FKKKFLKIPPKFLKVAKKF | seqid_3804 |
| variant_5049 | KWKKFLKIPPKFLKVAKKF | seqid_3805 |
| variant_5050 | RWKKFLKIPPKFLKVAKKF | seqid_3806 |
| variant_5051 | FWKKFLKIPPKFLKVAKKF | seqid_3807 |
| variant_5052 | KKKLLLKIPPKFLKVAKKF | seqid_3808 |
| variant_5053 | RKKLLLKIPPKFLKVAKKF | seqid_3809 |
| variant_5054 | FKKLLLKIPPKFLKVAKKF | seqid_3810 |
| variant_5055 | KWKLLLKIPPKFLKVAKKF | seqid_3811 |
| variant_5056 | RWKLLLKIPPKFLKVAKKF | seqid_3812 |
| variant_5057 | FWKLLLKIPPKFLKVAKKF | seqid_3813 |
| variant_5058 | KKKKLLKIPPKFLKVAKKF | seqid_3814 |
| variant_5059 | RKKKLLKIPPKFLKVAKKF | seqid_3815 |
| variant_5060 | FKKKLLKIPPKFLKVAKKF | seqid_3816 |
| variant_5061 | KWKKLLKIPPKFLKVAKKF | seqid_3817 |
| variant_5062 | RWKKLLKIPPKFLKVAKKF | seqid_3818 |
| variant_5063 | FWKKLLKIPPKFLKVAKKF | seqid_3819 |
| variant_5064 | KKKLFKKIPPKFLKVAKKF | seqid_3820 |
| variant_5065 | RKKLFKKIPPKFLKVAKKF | seqid_3821 |
| variant_5066 | FKKLFKKIPPKFLKVAKKF | seqid_3822 |
| variant_5067 | KWKLFKKIPPKFLKVAKKF | seqid_3823 |
| variant_5068 | RWKLFKKIPPKFLKVAKKF | seqid_3824 |
| variant_5069 | FWKLFKKIPPKFLKVAKKF | seqid_3825 |
| variant_5070 | KKKKFKKIPPKFLKVAKKF | seqid_3826 |
| variant_5071 | RKKKFKKIPPKFLKVAKKF | seqid_3827 |
| variant_5072 | FKKKFKKIPPKFLKVAKKF | seqid_3828 |
| variant_5073 | KWKKFKKIPPKFLKVAKKF | seqid_3829 |
| variant_5074 | RWKKFKKIPPKFLKVAKKF | seqid_3830 |
| variant_5075 | FWKKFKKIPPKFLKVAKKF | seqid_3831 |
| variant_5076 | KKKLLKKIPPKFLKVAKKF | seqid_3832 |
| variant_5077 | RKKLLKKIPPKFLKVAKKF | seqid_3833 |
| variant_5078 | FKKLLKKIPPKFLKVAKKF | seqid_3834 |
| variant_5079 | KWKLLKKIPPKFLKVAKKF | seqid_3835 |
| variant_5080 | RWKLLKKIPPKFLKVAKKF | seqid_3836 |
| variant_5081 | FWKLLKKIPPKFLKVAKKF | seqid_3837 |
| variant_5082 | KKKKLKKIPPKFLKVAKKF | seqid_3838 |
| variant_5083 | RKKKLKKIPPKFLKVAKKF | seqid_3839 |
| variant_5084 | FKKKLKKIPPKFLKVAKKF | seqid_3840 |
| variant_5085 | KWKKLKKIPPKFLKVAKKF | seqid_3841 |
| variant_5086 | RWKKLKKIPPKFLKVAKKF | seqid_3842 |
| variant_5087 | FWKKLKKIPPKFLKVAKKF | seqid_3843 |
| variant_5136 | KKKLFLKIPKFLKVAKKF | seqid_3844 |
| variant_5137 | RKKLFLKIPKFLKVAKKF | seqid_3845 |
| variant_5138 | FKKLFLKIPKFLKVAKKF | seqid_3846 |
| variant_5139 | KWKLFLKIPKFLKVAKKF | seqid_3847 |
| variant_5140 | RWKLFLKIPKFLKVAKKF | seqid_3848 |
| variant_5141 | FWKLFLKIPKFLKVAKKF | seqid_3849 |
| variant_5142 | KKKKFLKIPKFLKVAKKF | seqid_3850 |
| variant_5143 | RKKKFLKIPKFLKVAKKF | seqid_3851 |
| variant_5144 | FKKKFLKIPKFLKVAKKF | seqid_3852 |
| variant_5145 | KWKKFLKIPKFLKVAKKF | seqid_3853 |
| variant_5146 | RWKKFLKIPKFLKVAKKF | seqid_3854 |
| variant_5147 | FWKKFLKIPKFLKVAKKF | seqid_3855 |
| variant_5148 | KKKLLLKIPKFLKVAKKF | seqid_3856 |
| variant_5149 | RKKLLLKIPKFLKVAKKF | seqid_3857 |
| variant_5150 | FKKLLLKIPKFLKVAKKF | seqid_3858 |
| variant_5151 | KWKLLLKIPKFLKVAKKF | seqid_3859 |
| variant_5152 | RWKLLLKIPKFLKVAKKF | seqid_3860 |
| variant_5153 | FWKLLLKIPKFLKVAKKF | seqid_3861 |
| variant_5154 | KKKKLLKIPKFLKVAKKF | seqid_3862 |
| variant_5155 | RKKKLLKIPKFLKVAKKF | seqid_3863 |
| variant_5156 | FKKKLLKIPKFLKVAKKF | seqid_3864 |
| variant_5157 | KWKKLLKIPKFLKVAKKF | seqid_3865 |
| variant_5158 | RWKKLLKIPKFLKVAKKF | seqid_3866 |
| variant_5159 | FWKKLLKIPKFLKVAKKF | seqid_3867 |
| variant_5160 | KKKLFKKIPKFLKVAKKF | seqid_3868 |
| variant_5161 | RKKLFKKIPKFLKVAKKF | seqid_3869 |
| variant_5162 | FKKLFKKIPKFLKVAKKF | seqid_3870 |
| variant_5163 | KWKLFKKIPKFLKVAKKF | seqid_3871 |
| variant_5164 | RWKLFKKIPKFLKVAKKF | seqid_3872 |
| variant_5165 | FWKLFKKIPKFLKVAKKF | seqid_3873 |
| variant_5166 | KKKKFKKIPKFLKVAKKF | seqid_3874 |
| variant_5167 | RKKKFKKIPKFLKVAKKF | seqid_3875 |

| variant | sequence | seqid |
|---|---|---|
| variant_5168 | FKKKFKKIPKFLKVAKKF | seqid_3876 |
| variant_5169 | KWKKFKKIPKFLKVAKKF | seqid_3877 |
| variant_5170 | RWKKFKKIPKFLKVAKKF | seqid_3878 |
| variant_5171 | FWKKFKKIPKFLKVAKKF | seqid_3879 |
| variant_5172 | KKKLLKKIPKFLKVAKKF | seqid_3880 |
| variant_5173 | RKKLLKKIPKFLKVAKKF | seqid_3881 |
| variant_5174 | FKKLLKKIPKFLKVAKKF | seqid_3882 |
| variant_5175 | KWKLLKKIPKFLKVAKKF | seqid_3883 |
| variant_5176 | RWKLLKKIPKFLKVAKKF | seqid_3884 |
| variant_5177 | FWKLLKKIPKFLKVAKKF | seqid_3885 |
| variant_5178 | KKKKLKKIPKFLKVAKKF | seqid_3886 |
| variant_5179 | RKKKLKKIPKFLKVAKKF | seqid_3887 |
| variant_5180 | FKKKLKKIPKFLKVAKKF | seqid_3888 |
| variant_5181 | KWKKLKKIPKFLKVAKKF | seqid_3889 |
| variant_5182 | RWKKLKKIPKFLKVAKKF | seqid_3890 |
| variant_5183 | FWKKLKKIPKFLKVAKKF | seqid_3891 |
| variant_5184 | KKKLFLKIPPPKFKKVAKKF | seqid_3892 |
| variant_5185 | RKKLFLKIPPPKFKKVAKKF | seqid_3893 |
| variant_5186 | FKKLFLKIPPPKFKKVAKKF | seqid_3894 |
| variant_5187 | KWKLFLKIPPPKFKKVAKKF | seqid_3895 |
| variant_5188 | RWKLFLKIPPPKFKKVAKKF | seqid_3896 |
| variant_5189 | FWKLFLKIPPPKFKKVAKKF | seqid_3897 |
| variant_5190 | KKKKFLKIPPPKFKKVAKKF | seqid_3898 |
| variant_5191 | RKKKFLKIPPPKFKKVAKKF | seqid_3899 |
| variant_5192 | FKKKFLKIPPPKFKKVAKKF | seqid_3900 |
| variant_5193 | KWKKFLKIPPPKFKKVAKKF | seqid_3901 |
| variant_5194 | RWKKFLKIPPPKFKKVAKKF | seqid_3902 |
| variant_5195 | FWKKFLKIPPPKFKKVAKKF | seqid_3903 |
| variant_5196 | KKKLLLKIPPPKFKKVAKKF | seqid_3904 |
| variant_5197 | RKKLLLKIPPPKFKKVAKKF | seqid_3905 |
| variant_5198 | FKKLLLKIPPPKFKKVAKKF | seqid_3906 |
| variant_5199 | KWKLLLKIPPPKFKKVAKKF | seqid_3907 |
| variant_5200 | RWKLLLKIPPPKFKKVAKKF | seqid_3908 |
| variant_5201 | FWKLLLKIPPPKFKKVAKKF | seqid_3909 |
| variant_5202 | KKKKLLKIPPPKFKKVAKKF | seqid_3910 |
| variant_5203 | RKKKLLKIPPPKFKKVAKKF | seqid_3911 |
| variant_5204 | FKKKLLKIPPPKFKKVAKKF | seqid_3912 |
| variant_5205 | KWKKLLKIPPPKFKKVAKKF | seqid_3913 |
| variant_5206 | RWKKLLKIPPPKFKKVAKKF | seqid_3914 |
| variant_5207 | FWKKLLKIPPPKFKKVAKKF | seqid_3915 |
| variant_5208 | KKKLFKKIPPPKFKKVAKKF | seqid_3916 |
| variant_5209 | RKKLFKKIPPPKFKKVAKKF | seqid_3917 |
| variant_5210 | FKKLFKKIPPPKFKKVAKKF | seqid_3918 |
| variant_5211 | KWKLFKKIPPPKFKKVAKKF | seqid_3919 |
| variant_5212 | RWKLFKKIPPPKFKKVAKKF | seqid_3920 |
| variant_5213 | FWKLFKKIPPPKFKKVAKKF | seqid_3921 |
| variant_5214 | KKKKFKKIPPPKFKKVAKKF | seqid_3922 |
| variant_5215 | RKKKFKKIPPPKFKKVAKKF | seqid_3923 |
| variant_5216 | FKKKFKKIPPPKFKKVAKKF | seqid_3924 |
| variant_5217 | KWKKFKKIPPPKFKKVAKKF | seqid_3925 |
| variant_5218 | RWKKFKKIPPPKFKKVAKKF | seqid_3926 |
| variant_5219 | FWKKFKKIPPPKFKKVAKKF | seqid_3927 |
| variant_5220 | KKKLLKKIPPPKFKKVAKKF | seqid_3928 |
| variant_5221 | RKKLLKKIPPPKFKKVAKKF | seqid_3929 |
| variant_5222 | FKKLLKKIPPPKFKKVAKKF | seqid_3930 |
| variant_5223 | KWKLLKKIPPPKFKKVAKKF | seqid_3931 |
| variant_5224 | RWKLLKKIPPPKFKKVAKKF | seqid_3932 |
| variant_5225 | FWKLLKKIPPPKFKKVAKKF | seqid_3933 |
| variant_5226 | KKKKLKKIPPPKFKKVAKKF | seqid_3934 |
| variant_5227 | RKKKLKKIPPPKFKKVAKKF | seqid_3935 |
| variant_5228 | FKKKLKKIPPPKFKKVAKKF | seqid_3936 |
| variant_5229 | KWKKLKKIPPPKFKKVAKKF | seqid_3937 |
| variant_5230 | RWKKLKKIPPPKFKKVAKKF | seqid_3938 |
| variant_5231 | FWKKLKKIPPPKFKKVAKKF | seqid_3939 |
| variant_5232 | KKKLFLKIPPKFKKVAKKF | seqid_3940 |
| variant_5233 | RKKLFLKIPPKFKKVAKKF | seqid_3941 |
| variant_5234 | FKKLFLKIPPKFKKVAKKF | seqid_3942 |
| variant_5235 | KWKLFLKIPPKFKKVAKKF | seqid_3943 |
| variant_5236 | RWKLFLKIPPKFKKVAKKF | seqid_3944 |
| variant_5237 | FWKLFLKIPPKFKKVAKKF | seqid_3945 |
| variant_5238 | KKKKFLKIPPKFKKVAKKF | seqid_3946 |
| variant_5239 | RKKKFLKIPPKFKKVAKKF | seqid_3947 |
| variant_5240 | FKKKFLKIPPKFKKVAKKF | seqid_3948 |
| variant_5241 | KWKKFLKIPPKFKKVAKKF | seqid_3949 |
| variant_5242 | RWKKFLKIPPKFKKVAKKF | seqid_3950 |
| variant_5243 | FWKKFLKIPPKFKKVAKKF | seqid_3951 |
| variant_5244 | KKKLLLKIPPKFKKVAKKF | seqid_3952 |
| variant_5245 | RKKLLLKIPPKFKKVAKKF | seqid_3953 |
| variant_5246 | FKKLLLKIPPKFKKVAKKF | seqid_3954 |
| variant_5247 | KWKLLLKIPPKFKKVAKKF | seqid_3955 |
| variant_5248 | RWKLLLKIPPKFKKVAKKF | seqid_3956 |

| | | |
|---|---|---|
| variant_5249 | FWKLLLKIPPKFKKVAKKF | seqid_3957 |
| variant_5250 | KKKKLLKIPPKFKKVAKKF | seqid_3958 |
| variant_5251 | RKKKLLKIPPKFKKVAKKF | seqid_3959 |
| variant_5252 | FKKKLLKIPPKFKKVAKKF | seqid_3960 |
| variant_5253 | KWKKLLKIPPKFKKVAKKF | seqid_3961 |
| variant_5254 | RWKKLLKIPPKFKKVAKKF | seqid_3962 |
| variant_5255 | FWKKLLKIPPKFKKVAKKF | seqid_3963 |
| variant_5256 | KKKLFKKIPPKFKKVAKKF | seqid_3964 |
| variant_5257 | RKKLFKKIPPKFKKVAKKF | seqid_3965 |
| variant_5258 | FKKLFKKIPPKFKKVAKKF | seqid_3966 |
| variant_5259 | KWKLFKKIPPKFKKVAKKF | seqid_3967 |
| variant_5260 | RWKLFKKIPPKFKKVAKKF | seqid_3968 |
| variant_5261 | FWKLFKKIPPKFKKVAKKF | seqid_3969 |
| variant_5262 | KKKKFKKIPPKFKKVAKKF | seqid_3970 |
| variant_5263 | RKKKFKKIPPKFKKVAKKF | seqid_3971 |
| variant_5264 | FKKKFKKIPPKFKKVAKKF | seqid_3972 |
| variant_5265 | KWKKFKKIPPKFKKVAKKF | seqid_3973 |
| variant_5266 | RWKKFKKIPPKFKKVAKKF | seqid_3974 |
| variant_5267 | FWKKFKKIPPKFKKVAKKF | seqid_3975 |
| variant_5268 | KKKLLKKIPPKFKKVAKKF | seqid_3976 |
| variant_5269 | RKKLLKKIPPKFKKVAKKF | seqid_3977 |
| variant_5270 | FKKLLKKIPPKFKKVAKKF | seqid_3978 |
| variant_5271 | KWKLLKKIPPKFKKVAKKF | seqid_3979 |
| variant_5272 | RWKLLKKIPPKFKKVAKKF | seqid_3980 |
| variant_5273 | FWKLLKKIPPKFKKVAKKF | seqid_3981 |
| variant_5274 | KKKKLKKIPPKFKKVAKKF | seqid_3982 |
| variant_5275 | RKKKLKKIPPKFKKVAKKF | seqid_3983 |
| variant_5276 | FKKKLKKIPPKFKKVAKKF | seqid_3984 |
| variant_5277 | KWKKLKKIPPKFKKVAKKF | seqid_3985 |
| variant_5278 | RWKKLKKIPPKFKKVAKKF | seqid_3986 |
| variant_5279 | FWKKLKKIPPKFKKVAKKF | seqid_3987 |
| variant_5328 | KKKLFLKIPKFKKVAKKF | seqid_3988 |
| variant_5329 | RKKLFLKIPKFKKVAKKF | seqid_3989 |
| variant_5330 | FKKLFLKIPKFKKVAKKF | seqid_3990 |
| variant_5331 | KWKLFLKIPKFKKVAKKF | seqid_3991 |
| variant_5332 | RWKLFLKIPKFKKVAKKF | seqid_3992 |
| variant_5333 | FWKLFLKIPKFKKVAKKF | seqid_3993 |
| variant_5334 | KKKKFLKIPKFKKVAKKF | seqid_3994 |
| variant_5335 | RKKKFLKIPKFKKVAKKF | seqid_3995 |
| variant_5336 | FKKKFLKIPKFKKVAKKF | seqid_3996 |
| variant_5337 | KWKKFLKIPKFKKVAKKF | seqid_3997 |
| variant_5338 | RWKKFLKIPKFKKVAKKF | seqid_3998 |
| variant_5339 | FWKKFLKIPKFKKVAKKF | seqid_3999 |
| variant_5340 | KKKLLLKIPKFKKVAKKF | seqid_4000 |
| variant_5341 | RKKLLLKIPKFKKVAKKF | seqid_4001 |
| variant_5342 | FKKLLLKIPKFKKVAKKF | seqid_4002 |
| variant_5343 | KWKLLLKIPKFKKVAKKF | seqid_4003 |
| variant_5344 | RWKLLLKIPKFKKVAKKF | seqid_4004 |
| variant_5345 | FWKLLLKIPKFKKVAKKF | seqid_4005 |
| variant_5346 | KKKKLLKIPKFKKVAKKF | seqid_4006 |
| variant_5347 | RKKKLLKIPKFKKVAKKF | seqid_4007 |
| variant_5348 | FKKKLLKIPKFKKVAKKF | seqid_4008 |
| variant_5349 | KWKKLLKIPKFKKVAKKF | seqid_4009 |
| variant_5350 | RWKKLLKIPKFKKVAKKF | seqid_4010 |
| variant_5351 | FWKKLLKIPKFKKVAKKF | seqid_4011 |
| variant_5352 | KKKLFKKIPKFKKVAKKF | seqid_4012 |
| variant_5353 | RKKLFKKIPKFKKVAKKF | seqid_4013 |
| variant_5354 | FKKLFKKIPKFKKVAKKF | seqid_4014 |
| variant_5355 | KWKLFKKIPKFKKVAKKF | seqid_4015 |
| variant_5356 | RWKLFKKIPKFKKVAKKF | seqid_4016 |
| variant_5357 | FWKLFKKIPKFKKVAKKF | seqid_4017 |
| variant_5358 | KKKKFKKIPKFKKVAKKF | seqid_4018 |
| variant_5359 | RKKKFKKIPKFKKVAKKF | seqid_4019 |
| variant_5360 | FKKKFKKIPKFKKVAKKF | seqid_4020 |
| variant_5361 | KWKKFKKIPKFKKVAKKF | seqid_4021 |
| variant_5362 | RWKKFKKIPKFKKVAKKF | seqid_4022 |
| variant_5363 | FWKKFKKIPKFKKVAKKF | seqid_4023 |
| variant_5364 | KKKLLKKIPKFKKVAKKF | seqid_4024 |
| variant_5365 | RKKLLKKIPKFKKVAKKF | seqid_4025 |
| variant_5366 | FKKLLKKIPKFKKVAKKF | seqid_4026 |
| variant_5367 | KWKLLKKIPKFKKVAKKF | seqid_4027 |
| variant_5368 | RWKLLKKIPKFKKVAKKF | seqid_4028 |
| variant_5369 | FWKLLKKIPKFKKVAKKF | seqid_4029 |
| variant_5370 | KKKKLKKIPKFKKVAKKF | seqid_4030 |
| variant_5371 | RKKKLKKIPKFKKVAKKF | seqid_4031 |
| variant_5372 | FKKKLKKIPKFKKVAKKF | seqid_4032 |
| variant_5373 | KWKKLKKIPKFKKVAKKF | seqid_4033 |
| variant_5374 | RWKKLKKIPKFKKVAKKF | seqid_4034 |
| variant_5375 | FWKKLKKIPKFKKVAKKF | seqid_4035 |
| variant_5376 | KKKLFLKIPPPKFLHSAKKF | seqid_4036 |
| variant_5377 | RKKLFLKIPPPKFLHSAKKF | seqid_4037 |

| variant_5378 | FKKLFLKIPPPKFLHSAKKF | seqid_4038 |
| variant_5379 | KWKLFLKIPPPKFLHSAKKF | seqid_4039 |
| variant_5380 | RWKLFLKIPPPKFLHSAKKF | seqid_4040 |
| variant_5381 | FWKLFLKIPPPKFLHSAKKF | seqid_4041 |
| variant_5382 | KKKKFLKIPPPKFLHSAKKF | seqid_4042 |
| variant_5383 | RKKKFLKIPPPKFLHSAKKF | seqid_4043 |
| variant_5384 | FKKKFLKIPPPKFLHSAKKF | seqid_4044 |
| variant_5385 | KWKKFLKIPPPKFLHSAKKF | seqid_4045 |
| variant_5386 | RWKKFLKIPPPKFLHSAKKF | seqid_4046 |
| variant_5387 | FWKKFLKIPPPKFLHSAKKF | seqid_4047 |
| variant_5388 | KKKLLLKIPPPKFLHSAKKF | seqid_4048 |
| variant_5389 | RKKLLLKIPPPKFLHSAKKF | seqid_4049 |
| variant_5390 | FKKLLLKIPPPKFLHSAKKF | seqid_4050 |
| variant_5391 | KWKLLLKIPPPKFLHSAKKF | seqid_4051 |
| variant_5392 | RWKLLLKIPPPKFLHSAKKF | seqid_4052 |
| variant_5393 | FWKLLLKIPPPKFLHSAKKF | seqid_4053 |
| variant_5394 | KKKKLLKIPPPKFLHSAKKF | seqid_4054 |
| variant_5395 | RKKKLLKIPPPKFLHSAKKF | seqid_4055 |
| variant_5396 | FKKKLLKIPPPKFLHSAKKF | seqid_4056 |
| variant_5397 | KWKKLLKIPPPKFLHSAKKF | seqid_4057 |
| variant_5398 | RWKKLLKIPPPKFLHSAKKF | seqid_4058 |
| variant_5399 | FWKKLLKIPPPKFLHSAKKF | seqid_4059 |
| variant_5400 | KKKLFKKIPPPKFLHSAKKF | seqid_4060 |
| variant_5401 | RKKLFKKIPPPKFLHSAKKF | seqid_4061 |
| variant_5402 | FKKLFKKIPPPKFLHSAKKF | seqid_4062 |
| variant_5403 | KWKLFKKIPPPKFLHSAKKF | seqid_4063 |
| variant_5404 | RWKLFKKIPPPKFLHSAKKF | seqid_4064 |
| variant_5405 | FWKLFKKIPPPKFLHSAKKF | seqid_4065 |
| variant_5406 | KKKKFKKIPPPKFLHSAKKF | seqid_4066 |
| variant_5407 | RKKKFKKIPPPKFLHSAKKF | seqid_4067 |
| variant_5408 | FKKKFKKIPPPKFLHSAKKF | seqid_4068 |
| variant_5409 | KWKKFKKIPPPKFLHSAKKF | seqid_4069 |
| variant_5410 | RWKKFKKIPPPKFLHSAKKF | seqid_4070 |
| variant_5411 | FWKKFKKIPPPKFLHSAKKF | seqid_4071 |
| variant_5412 | KKKLLKKIPPPKFLHSAKKF | seqid_4072 |
| variant_5413 | RKKLLKKIPPPKFLHSAKKF | seqid_4073 |
| variant_5414 | FKKLLKKIPPPKFLHSAKKF | seqid_4074 |
| variant_5415 | KWKLLKKIPPPKFLHSAKKF | seqid_4075 |
| variant_5416 | RWKLLKKIPPPKFLHSAKKF | seqid_4076 |
| variant_5417 | FWKLLKKIPPPKFLHSAKKF | seqid_4077 |
| variant_5418 | KKKKLKKIPPPKFLHSAKKF | seqid_4078 |
| variant_5419 | RKKKLKKIPPPKFLHSAKKF | seqid_4079 |
| variant_5420 | FKKKLKKIPPPKFLHSAKKF | seqid_4080 |
| variant_5421 | KWKKLKKIPPPKFLHSAKKF | seqid_4081 |
| variant_5422 | RWKKLKKIPPPKFLHSAKKF | seqid_4082 |
| variant_5423 | FWKKLKKIPPPKFLHSAKKF | seqid_4083 |
| variant_5424 | KKKLFLKIPPKFLHSAKKF | seqid_4084 |
| variant_5425 | RKKLFLKIPPKFLHSAKKF | seqid_4085 |
| variant_5426 | FKKLFLKIPPKFLHSAKKF | seqid_4086 |
| variant_5427 | KWKLFLKIPPKFLHSAKKF | seqid_4087 |
| variant_5428 | RWKLFLKIPPKFLHSAKKF | seqid_4088 |
| variant_5429 | FWKLFLKIPPKFLHSAKKF | seqid_4089 |
| variant_5430 | KKKKFLKIPPKFLHSAKKF | seqid_4090 |
| variant_5431 | RKKKFLKIPPKFLHSAKKF | seqid_4091 |
| variant_5432 | FKKKFLKIPPKFLHSAKKF | seqid_4092 |
| variant_5433 | KWKKFLKIPPKFLHSAKKF | seqid_4093 |
| variant_5434 | RWKKFLKIPPKFLHSAKKF | seqid_4094 |
| variant_5435 | FWKKFLKIPPKFLHSAKKF | seqid_4095 |
| variant_5436 | KKKLLLKIPPKFLHSAKKF | seqid_4096 |
| variant_5437 | RKKLLLKIPPKFLHSAKKF | seqid_4097 |
| variant_5438 | FKKLLLKIPPKFLHSAKKF | seqid_4098 |
| variant_5439 | KWKLLLKIPPKFLHSAKKF | seqid_4099 |
| variant_5440 | RWKLLLKIPPKFLHSAKKF | seqid_4100 |
| variant_5441 | FWKLLLKIPPKFLHSAKKF | seqid_4101 |
| variant_5442 | KKKKLLKIPPKFLHSAKKF | seqid_4102 |
| variant_5443 | RKKKLLKIPPKFLHSAKKF | seqid_4103 |
| variant_5444 | FKKKLLKIPPKFLHSAKKF | seqid_4104 |
| variant_5445 | KWKKLLKIPPKFLHSAKKF | seqid_4105 |
| variant_5446 | RWKKLLKIPPKFLHSAKKF | seqid_4106 |
| variant_5447 | FWKKLLKIPPKFLHSAKKF | seqid_4107 |
| variant_5448 | KKKLFKKIPPKFLHSAKKF | seqid_4108 |
| variant_5449 | RKKLFKKIPPKFLHSAKKF | seqid_4109 |
| variant_5450 | FKKLFKKIPPKFLHSAKKF | seqid_4110 |
| variant_5451 | KWKLFKKIPPKFLHSAKKF | seqid_4111 |
| variant_5452 | RWKLFKKIPPKFLHSAKKF | seqid_4112 |
| variant_5453 | FWKLFKKIPPKFLHSAKKF | seqid_4113 |
| variant_5454 | KKKKFKKIPPKFLHSAKKF | seqid_4114 |
| variant_5455 | RKKKFKKIPPKFLHSAKKF | seqid_4115 |
| variant_5456 | FKKKFKKIPPKFLHSAKKF | seqid_4116 |
| variant_5457 | KWKKFKKIPPKFLHSAKKF | seqid_4117 |
| variant_5458 | RWKKFKKIPPKFLHSAKKF | seqid_4118 |

| variant_5459 | FWKKFKKIPPKFLHSAKKF | seqid_4119 |
| variant_5460 | KKKLLKKIPPKFLHSAKKF | seqid_4120 |
| variant_5461 | RKKLLKKIPPKFLHSAKKF | seqid_4121 |
| variant_5462 | FKKLLKKIPPKFLHSAKKF | seqid_4122 |
| variant_5463 | KWKLLKKIPPKFLHSAKKF | seqid_4123 |
| variant_5464 | RWKLLKKIPPKFLHSAKKF | seqid_4124 |
| variant_5465 | FWKLLKKIPPKFLHSAKKF | seqid_4125 |
| variant_5466 | KKKKLKKIPPKFLHSAKKF | seqid_4126 |
| variant_5467 | RKKKLKKIPPKFLHSAKKF | seqid_4127 |
| variant_5468 | FKKKLKKIPPKFLHSAKKF | seqid_4128 |
| variant_5469 | KWKKLKKIPPKFLHSAKKF | seqid_4129 |
| variant_5470 | RWKKLKKIPPKFLHSAKKF | seqid_4130 |
| variant_5471 | FWKKLKKIPPKFLHSAKKF | seqid_4131 |
| variant_5520 | KKKLFLKIPKFLHSAKKF | seqid_4132 |
| variant_5521 | RKKLFLKIPKFLHSAKKF | seqid_4133 |
| variant_5522 | FKKLFLKIPKFLHSAKKF | seqid_4134 |
| variant_5523 | KWKLFLKIPKFLHSAKKF | seqid_4135 |
| variant_5524 | RWKLFLKIPKFLHSAKKF | seqid_4136 |
| variant_5525 | FWKLFLKIPKFLHSAKKF | seqid_4137 |
| variant_5526 | KKKKFLKIPKFLHSAKKF | seqid_4138 |
| variant_5527 | RKKKFLKIPKFLHSAKKF | seqid_4139 |
| variant_5528 | FKKKFLKIPKFLHSAKKF | seqid_4140 |
| variant_5529 | KWKKFLKIPKFLHSAKKF | seqid_4141 |
| variant_5530 | RWKKFLKIPKFLHSAKKF | seqid_4142 |
| variant_5531 | FWKKFLKIPKFLHSAKKF | seqid_4143 |
| variant_5532 | KKKLLLKIPKFLHSAKKF | seqid_4144 |
| variant_5533 | RKKLLLKIPKFLHSAKKF | seqid_4145 |
| variant_5534 | FKKLLLKIPKFLHSAKKF | seqid_4146 |
| variant_5535 | KWKLLLKIPKFLHSAKKF | seqid_4147 |
| variant_5536 | RWKLLLKIPKFLHSAKKF | seqid_4148 |
| variant_5537 | FWKLLLKIPKFLHSAKKF | seqid_4149 |
| variant_5538 | KKKKLLKIPKFLHSAKKF | seqid_4150 |
| variant_5539 | RKKKLLKIPKFLHSAKKF | seqid_4151 |
| variant_5540 | FKKKLLKIPKFLHSAKKF | seqid_4152 |
| variant_5541 | KWKKLLKIPKFLHSAKKF | seqid_4153 |
| variant_5542 | RWKKLLKIPKFLHSAKKF | seqid_4154 |
| variant_5543 | FWKKLLKIPKFLHSAKKF | seqid_4155 |
| variant_5544 | KKKLFKKIPKFLHSAKKF | seqid_4156 |
| variant_5545 | RKKLFKKIPKFLHSAKKF | seqid_4157 |
| variant_5546 | FKKLFKKIPKFLHSAKKF | seqid_4158 |
| variant_5547 | KWKLFKKIPKFLHSAKKF | seqid_4159 |
| variant_5548 | RWKLFKKIPKFLHSAKKF | seqid_4160 |
| variant_5549 | FWKLFKKIPKFLHSAKKF | seqid_4161 |
| variant_5550 | KKKKFKKIPKFLHSAKKF | seqid_4162 |
| variant_5551 | RKKKFKKIPKFLHSAKKF | seqid_4163 |
| variant_5552 | FKKKFKKIPKFLHSAKKF | seqid_4164 |
| variant_5553 | KWKKFKKIPKFLHSAKKF | seqid_4165 |
| variant_5554 | RWKKFKKIPKFLHSAKKF | seqid_4166 |
| variant_5555 | FWKKFKKIPKFLHSAKKF | seqid_4167 |
| variant_5556 | KKKLLKKIPKFLHSAKKF | seqid_4168 |
| variant_5557 | RKKLLKKIPKFLHSAKKF | seqid_4169 |
| variant_5558 | FKKLLKKIPKFLHSAKKF | seqid_4170 |
| variant_5559 | KWKLLKKIPKFLHSAKKF | seqid_4171 |
| variant_5560 | RWKLLKKIPKFLHSAKKF | seqid_4172 |
| variant_5561 | FWKLLKKIPKFLHSAKKF | seqid_4173 |
| variant_5562 | KKKKLKKIPKFLHSAKKF | seqid_4174 |
| variant_5563 | RKKKLKKIPKFLHSAKKF | seqid_4175 |
| variant_5564 | FKKKLKKIPKFLHSAKKF | seqid_4176 |
| variant_5565 | KWKKLKKIPKFLHSAKKF | seqid_4177 |
| variant_5566 | RWKKLKKIPKFLHSAKKF | seqid_4178 |
| variant_5567 | FWKKLKKIPKFLHSAKKF | seqid_4179 |
| variant_5568 | KKKLFLKIPPPKFKHSAKKF | seqid_4180 |
| variant_5569 | RKKLFLKIPPPKFKHSAKKF | seqid_4181 |
| variant_5570 | FKKLFLKIPPPKFKHSAKKF | seqid_4182 |
| variant_5571 | KWKLFLKIPPPKFKHSAKKF | seqid_4183 |
| variant_5572 | RWKLFLKIPPPKFKHSAKKF | seqid_4184 |
| variant_5573 | FWKLFLKIPPPKFKHSAKKF | seqid_4185 |
| variant_5574 | KKKKFLKIPPPKFKHSAKKF | seqid_4186 |
| variant_5575 | RKKKFLKIPPPKFKHSAKKF | seqid_4187 |
| variant_5576 | FKKKFLKIPPPKFKHSAKKF | seqid_4188 |
| variant_5577 | KWKKFLKIPPPKFKHSAKKF | seqid_4189 |
| variant_5578 | RWKKFLKIPPPKFKHSAKKF | seqid_4190 |
| variant_5579 | FWKKFLKIPPPKFKHSAKKF | seqid_4191 |
| variant_5580 | KKKLLLKIPPPKFKHSAKKF | seqid_4192 |
| variant_5581 | RKKLLLKIPPPKFKHSAKKF | seqid_4193 |
| variant_5582 | FKKLLLKIPPPKFKHSAKKF | seqid_4194 |
| variant_5583 | KWKLLLKIPPPKFKHSAKKF | seqid_4195 |
| variant_5584 | RWKLLLKIPPPKFKHSAKKF | seqid_4196 |
| variant_5585 | FWKLLLKIPPPKFKHSAKKF | seqid_4197 |
| variant_5586 | KKKKLLKIPPPKFKHSAKKF | seqid_4198 |
| variant_5587 | RKKKLLKIPPPKFKHSAKKF | seqid_4199 |

| | | |
|---|---|---|
| variant_5588 | FKKKLLKIPPPKFKHSAKKF | seqid_4200 |
| variant_5589 | KWKKLLKIPPPKFKHSAKKF | seqid_4201 |
| variant_5590 | RWKKLLKIPPPKFKHSAKKF | seqid_4202 |
| variant_5591 | FWKKLLKIPPPKFKHSAKKF | seqid_4203 |
| variant_5592 | KKKLFKKIPPPKFKHSAKKF | seqid_4204 |
| variant_5593 | RKKLFKKIPPPKFKHSAKKF | seqid_4205 |
| variant_5594 | FKKLFKKIPPPKFKHSAKKF | seqid_4206 |
| variant_5595 | KWKLFKKIPPPKFKHSAKKF | seqid_4207 |
| variant_5596 | RWKLFKKIPPPKFKHSAKKF | seqid_4208 |
| variant_5597 | FWKLFKKIPPPKFKHSAKKF | seqid_4209 |
| variant_5598 | KKKKFKKIPPPKFKHSAKKF | seqid_4210 |
| variant_5599 | RKKKFKKIPPPKFKHSAKKF | seqid_4211 |
| variant_5600 | FKKKFKKIPPPKFKHSAKKF | seqid_4212 |
| variant_5601 | KWKKFKKIPPPKFKHSAKKF | seqid_4213 |
| variant_5602 | RWKKFKKIPPPKFKHSAKKF | seqid_4214 |
| variant_5603 | FWKKFKKIPPPKFKHSAKKF | seqid_4215 |
| variant_5604 | KKKLLKKIPPPKFKHSAKKF | seqid_4216 |
| variant_5605 | RKKLLKKIPPPKFKHSAKKF | seqid_4217 |
| variant_5606 | FKKLLKKIPPPKFKHSAKKF | seqid_4218 |
| variant_5607 | KWKLLKKIPPPKFKHSAKKF | seqid_4219 |
| variant_5608 | RWKLLKKIPPPKFKHSAKKF | seqid_4220 |
| variant_5609 | FWKLLKKIPPPKFKHSAKKF | seqid_4221 |
| variant_5610 | KKKKLKKIPPPKFKHSAKKF | seqid_4222 |
| variant_5611 | RKKKLKKIPPPKFKHSAKKF | seqid_4223 |
| variant_5612 | FKKKLKKIPPPKFKHSAKKF | seqid_4224 |
| variant_5613 | KWKKLKKIPPPKFKHSAKKF | seqid_4225 |
| variant_5614 | RWKKLKKIPPPKFKHSAKKF | seqid_4226 |
| variant_5615 | FWKKLKKIPPPKFKHSAKKF | seqid_4227 |
| variant_5616 | KKKLFLKIPPKFKHSAKKF | seqid_4228 |
| variant_5617 | RKKLFLKIPPKFKHSAKKF | seqid_4229 |
| variant_5618 | FKKLFLKIPPKFKHSAKKF | seqid_4230 |
| variant_5619 | KWKLFLKIPPKFKHSAKKF | seqid_4231 |
| variant_5620 | RWKLFLKIPPKFKHSAKKF | seqid_4232 |
| variant_5621 | FWKLFLKIPPKFKHSAKKF | seqid_4233 |
| variant_5622 | KKKKFLKIPPKFKHSAKKF | seqid_4234 |
| variant_5623 | RKKKFLKIPPKFKHSAKKF | seqid_4235 |
| variant_5624 | FKKKFLKIPPKFKHSAKKF | seqid_4236 |
| variant_5625 | KWKKFLKIPPKFKHSAKKF | seqid_4237 |
| variant_5626 | RWKKFLKIPPKFKHSAKKF | seqid_4238 |
| variant_5627 | FWKKFLKIPPKFKHSAKKF | seqid_4239 |
| variant_5628 | KKKLLLKIPPKFKHSAKKF | seqid_4240 |
| variant_5629 | RKKLLLKIPPKFKHSAKKF | seqid_4241 |
| variant_5630 | FKKLLLKIPPKFKHSAKKF | seqid_4242 |
| variant_5631 | KWKLLLKIPPKFKHSAKKF | seqid_4243 |
| variant_5632 | RWKLLLKIPPKFKHSAKKF | seqid_4244 |
| variant_5633 | FWKLLLKIPPKFKHSAKKF | seqid_4245 |
| variant_5634 | KKKKLLKIPPKFKHSAKKF | seqid_4246 |
| variant_5635 | RKKKLLKIPPKFKHSAKKF | seqid_4247 |
| variant_5636 | FKKKLLKIPPKFKHSAKKF | seqid_4248 |
| variant_5637 | KWKKLLKIPPKFKHSAKKF | seqid_4249 |
| variant_5638 | RWKKLLKIPPKFKHSAKKF | seqid_4250 |
| variant_5639 | FWKKLLKIPPKFKHSAKKF | seqid_4251 |
| variant_5640 | KKKLFKKIPPKFKHSAKKF | seqid_4252 |
| variant_5641 | RKKLFKKIPPKFKHSAKKF | seqid_4253 |
| variant_5642 | FKKLFKKIPPKFKHSAKKF | seqid_4254 |
| variant_5643 | KWKLFKKIPPKFKHSAKKF | seqid_4255 |
| variant_5644 | RWKLFKKIPPKFKHSAKKF | seqid_4256 |
| variant_5645 | FWKLFKKIPPKFKHSAKKF | seqid_4257 |
| variant_5646 | KKKKFKKIPPKFKHSAKKF | seqid_4258 |
| variant_5647 | RKKKFKKIPPKFKHSAKKF | seqid_4259 |
| variant_5648 | FKKKFKKIPPKFKHSAKKF | seqid_4260 |
| variant_5649 | KWKKFKKIPPKFKHSAKKF | seqid_4261 |
| variant_5650 | RWKKFKKIPPKFKHSAKKF | seqid_4262 |
| variant_5651 | FWKKFKKIPPKFKHSAKKF | seqid_4263 |
| variant_5652 | KKKLLKKIPPKFKHSAKKF | seqid_4264 |
| variant_5653 | RKKLLKKIPPKFKHSAKKF | seqid_4265 |
| variant_5654 | FKKLLKKIPPKFKHSAKKF | seqid_4266 |
| variant_5655 | KWKLLKKIPPKFKHSAKKF | seqid_4267 |
| variant_5656 | RWKLLKKIPPKFKHSAKKF | seqid_4268 |
| variant_5657 | FWKLLKKIPPKFKHSAKKF | seqid_4269 |
| variant_5658 | KKKKLKKIPPKFKHSAKKF | seqid_4270 |
| variant_5659 | RKKKLKKIPPKFKHSAKKF | seqid_4271 |
| variant_5660 | FKKKLKKIPPKFKHSAKKF | seqid_4272 |
| variant_5661 | KWKKLKKIPPKFKHSAKKF | seqid_4273 |
| variant_5662 | RWKKLKKIPPKFKHSAKKF | seqid_4274 |
| variant_5663 | FWKKLKKIPPKFKHSAKKF | seqid_4275 |
| variant_5712 | KKKLFLKIPKFKHSAKKF | seqid_4276 |
| variant_5713 | RKKLFLKIPKFKHSAKKF | seqid_4277 |
| variant_5714 | FKKLFLKIPKFKHSAKKF | seqid_4278 |
| variant_5715 | KWKLFLKIPKFKHSAKKF | seqid_4279 |
| variant_5716 | RWKLFLKIPKFKHSAKKF | seqid_4280 |

| variant | sequence | seqid |
|---|---|---|
| variant_5717 | FWKLFLKIPKFKHSAKKF | seqid_4281 |
| variant_5718 | KKKKFLKIPKFKHSAKKF | seqid_4282 |
| variant_5719 | RKKKFLKIPKFKHSAKKF | seqid_4283 |
| variant_5720 | FKKKFLKIPKFKHSAKKF | seqid_4284 |
| variant_5721 | KWKKFLKIPKFKHSAKKF | seqid_4285 |
| variant_5722 | RWKKFLKIPKFKHSAKKF | seqid_4286 |
| variant_5723 | FWKKFLKIPKFKHSAKKF | seqid_4287 |
| variant_5724 | KKKLLLKIPKFKHSAKKF | seqid_4288 |
| variant_5725 | RKKLLLKIPKFKHSAKKF | seqid_4289 |
| variant_5726 | FKKLLLKIPKFKHSAKKF | seqid_4290 |
| variant_5727 | KWKLLLKIPKFKHSAKKF | seqid_4291 |
| variant_5728 | RWKLLLKIPKFKHSAKKF | seqid_4292 |
| variant_5729 | FWKLLLKIPKFKHSAKKF | seqid_4293 |
| variant_5730 | KKKKLLKIPKFKHSAKKF | seqid_4294 |
| variant_5731 | RKKKLLKIPKFKHSAKKF | seqid_4295 |
| variant_5732 | FKKKLLKIPKFKHSAKKF | seqid_4296 |
| variant_5733 | KWKKLLKIPKFKHSAKKF | seqid_4297 |
| variant_5734 | RWKKLLKIPKFKHSAKKF | seqid_4298 |
| variant_5735 | FWKKLLKIPKFKHSAKKF | seqid_4299 |
| variant_5736 | KKKLFKKIPKFKHSAKKF | seqid_4300 |
| variant_5737 | RKKLFKKIPKFKHSAKKF | seqid_4301 |
| variant_5738 | FKKLFKKIPKFKHSAKKF | seqid_4302 |
| variant_5739 | KWKLFKKIPKFKHSAKKF | seqid_4303 |
| variant_5740 | RWKLFKKIPKFKHSAKKF | seqid_4304 |
| variant_5741 | FWKLFKKIPKFKHSAKKF | seqid_4305 |
| variant_5742 | KKKKFKKIPKFKHSAKKF | seqid_4306 |
| variant_5743 | RKKKFKKIPKFKHSAKKF | seqid_4307 |
| variant_5744 | FKKKFKKIPKFKHSAKKF | seqid_4308 |
| variant_5745 | KWKKFKKIPKFKHSAKKF | seqid_4309 |
| variant_5746 | RWKKFKKIPKFKHSAKKF | seqid_4310 |
| variant_5747 | FWKKFKKIPKFKHSAKKF | seqid_4311 |
| variant_5748 | KKKLLKKIPKFKHSAKKF | seqid_4312 |
| variant_5749 | RKKLLKKIPKFKHSAKKF | seqid_4313 |
| variant_5750 | FKKLLKKIPKFKHSAKKF | seqid_4314 |
| variant_5751 | KWKLLKKIPKFKHSAKKF | seqid_4315 |
| variant_5752 | RWKLLKKIPKFKHSAKKF | seqid_4316 |
| variant_5753 | FWKLLKKIPKFKHSAKKF | seqid_4317 |
| variant_5754 | KKKKLKKIPKFKHSAKKF | seqid_4318 |
| variant_5755 | RKKKLKKIPKFKHSAKKF | seqid_4319 |
| variant_5756 | FKKKLKKIPKFKHSAKKF | seqid_4320 |
| variant_5757 | KWKKLKKIPKFKHSAKKF | seqid_4321 |
| variant_5758 | RWKKLKKIPKFKHSAKKF | seqid_4322 |
| variant_5759 | FWKKLKKIPKFKHSAKKF | seqid_4323 |
| variant_5760 | KKKLFLKIPPPKFLKSAKKF | seqid_4324 |
| variant_5761 | RKKLFLKIPPPKFLKSAKKF | seqid_4325 |
| variant_5762 | FKKLFLKIPPPKFLKSAKKF | seqid_4326 |
| variant_5763 | KWKLFLKIPPPKFLKSAKKF | seqid_4327 |
| variant_5764 | RWKLFLKIPPPKFLKSAKKF | seqid_4328 |
| variant_5765 | FWKLFLKIPPPKFLKSAKKF | seqid_4329 |
| variant_5766 | KKKKFLKIPPPKFLKSAKKF | seqid_4330 |
| variant_5767 | RKKKFLKIPPPKFLKSAKKF | seqid_4331 |
| variant_5768 | FKKKFLKIPPPKFLKSAKKF | seqid_4332 |
| variant_5769 | KWKKFLKIPPPKFLKSAKKF | seqid_4333 |
| variant_5770 | RWKKFLKIPPPKFLKSAKKF | seqid_4334 |
| variant_5771 | FWKKFLKIPPPKFLKSAKKF | seqid_4335 |
| variant_5772 | KKKLLLKIPPPKFLKSAKKF | seqid_4336 |
| variant_5773 | RKKLLLKIPPPKFLKSAKKF | seqid_4337 |
| variant_5774 | FKKLLLKIPPPKFLKSAKKF | seqid_4338 |
| variant_5775 | KWKLLLKIPPPKFLKSAKKF | seqid_4339 |
| variant_5776 | RWKLLLKIPPPKFLKSAKKF | seqid_4340 |
| variant_5777 | FWKLLLKIPPPKFLKSAKKF | seqid_4341 |
| variant_5778 | KKKKLLKIPPPKFLKSAKKF | seqid_4342 |
| variant_5779 | RKKKLLKIPPPKFLKSAKKF | seqid_4343 |
| variant_5780 | FKKKLLKIPPPKFLKSAKKF | seqid_4344 |
| variant_5781 | KWKKLLKIPPPKFLKSAKKF | seqid_4345 |
| variant_5782 | RWKKLLKIPPPKFLKSAKKF | seqid_4346 |
| variant_5783 | FWKKLLKIPPPKFLKSAKKF | seqid_4347 |
| variant_5784 | KKKLFKKIPPPKFLKSAKKF | seqid_4348 |
| variant_5785 | RKKLFKKIPPPKFLKSAKKF | seqid_4349 |
| variant_5786 | FKKLFKKIPPPKFLKSAKKF | seqid_4350 |
| variant_5787 | KWKLFKKIPPPKFLKSAKKF | seqid_4351 |
| variant_5788 | RWKLFKKIPPPKFLKSAKKF | seqid_4352 |
| variant_5789 | FWKLFKKIPPPKFLKSAKKF | seqid_4353 |
| variant_5790 | KKKKFKKIPPPKFLKSAKKF | seqid_4354 |
| variant_5791 | RKKKFKKIPPPKFLKSAKKF | seqid_4355 |
| variant_5792 | FKKKFKKIPPPKFLKSAKKF | seqid_4356 |
| variant_5793 | KWKKFKKIPPPKFLKSAKKF | seqid_4357 |
| variant_5794 | RWKKFKKIPPPKFLKSAKKF | seqid_4358 |
| variant_5795 | FWKKFKKIPPPKFLKSAKKF | seqid_4359 |
| variant_5796 | KKKLLKKIPPPKFLKSAKKF | seqid_4360 |
| variant_5797 | RKKLLKKIPPPKFLKSAKKF | seqid_4361 |

-continued

| | | |
|---|---|---|
| variant_5798 | FKKLLKKIPPPKFLKSAKKF | seqid_4362 |
| variant_5799 | KWKLLKKIPPPKFLKSAKKF | seqid_4363 |
| variant_5800 | RWKLLKKIPPPKFLKSAKKF | seqid_4364 |
| variant_5801 | FWKLLKKIPPPKFLKSAKKF | seqid_4365 |
| variant_5802 | KKKKLKKIPPPKFLKSAKKF | seqid_4366 |
| variant_5803 | RKKKLKKIPPPKFLKSAKKF | seqid_4367 |
| variant_5804 | FKKKLKKIPPPKFLKSAKKF | seqid_4368 |
| variant_5805 | KWKKLKKIPPPKFLKSAKKF | seqid_4369 |
| variant_5806 | RWKKLKKIPPPKFLKSAKKF | seqid_4370 |
| variant_5807 | FWKKLKKIPPPKFLKSAKKF | seqid_4371 |
| variant_5808 | KKKLFLKIPPKFLKSAKKF | seqid_4372 |
| variant_5809 | RKKLFLKIPPKFLKSAKKF | seqid_4373 |
| variant_5810 | FKKLFLKIPPKFLKSAKKF | seqid_4374 |
| variant_5811 | KWKLFLKIPPKFLKSAKKF | seqid_4375 |
| variant_5812 | RWKLFLKIPPKFLKSAKKF | seqid_4376 |
| variant_5813 | FWKLFLKIPPKFLKSAKKF | seqid_4377 |
| variant_5814 | KKKKFLKIPPKFLKSAKKF | seqid_4378 |
| variant_5815 | RKKKFLKIPPKFLKSAKKF | seqid_4379 |
| variant_5816 | FKKKFLKIPPKFLKSAKKF | seqid_4380 |
| variant_5817 | KWKKFLKIPPKFLKSAKKF | seqid_4381 |
| variant_5818 | RWKKFLKIPPKFLKSAKKF | seqid_4382 |
| variant_5819 | FWKKFLKIPPKFLKSAKKF | seqid_4383 |
| variant_5820 | KKKLLLKIPPKFLKSAKKF | seqid_4384 |
| variant_5821 | RKKLLLKIPPKFLKSAKKF | seqid_4385 |
| variant_5822 | FKKLLLKIPPKFLKSAKKF | seqid_4386 |
| variant_5823 | KWKLLLKIPPKFLKSAKKF | seqid_4387 |
| variant_5824 | RWKLLLKIPPKFLKSAKKF | seqid_4388 |
| variant_5825 | FWKLLLKIPPKFLKSAKKF | seqid_4389 |
| variant_5826 | KKKKLLKIPPKFLKSAKKF | seqid_4390 |
| variant_5827 | RKKKLLKIPPKFLKSAKKF | seqid_4391 |
| variant_5828 | FKKKLLKIPPKFLKSAKKF | seqid_4392 |
| variant_5829 | KWKKLLKIPPKFLKSAKKF | seqid_4393 |
| variant_5830 | RWKKLLKIPPKFLKSAKKF | seqid_4394 |
| variant_5831 | FWKKLLKIPPKFLKSAKKF | seqid_4395 |
| variant_5832 | KKKLFKKIPPKFLKSAKKF | seqid_4396 |
| variant_5833 | RKKLFKKIPPKFLKSAKKF | seqid_4397 |
| variant_5834 | FKKLFKKIPPKFLKSAKKF | seqid_4398 |
| variant_5835 | KWKLFKKIPPKFLKSAKKF | seqid_4399 |
| variant_5836 | RWKLFKKIPPKFLKSAKKF | seqid_4400 |
| variant_5837 | FWKLFKKIPPKFLKSAKKF | seqid_4401 |
| variant_5838 | KKKKFKKIPPKFLKSAKKF | seqid_4402 |
| variant_5839 | RKKKFKKIPPKFLKSAKKF | seqid_4403 |
| variant_5840 | FKKKFKKIPPKFLKSAKKF | seqid_4404 |
| variant_5841 | KWKKFKKIPPKFLKSAKKF | seqid_4405 |
| variant_5842 | RWKKFKKIPPKFLKSAKKF | seqid_4406 |
| variant_5843 | FWKKFKKIPPKFLKSAKKF | seqid_4407 |
| variant_5844 | KKKLLKKIPPKFLKSAKKF | seqid_4408 |
| variant_5845 | RKKLLKKIPPKFLKSAKKF | seqid_4409 |
| variant_5846 | FKKLLKKIPPKFLKSAKKF | seqid_4410 |
| variant_5847 | KWKLLKKIPPKFLKSAKKF | seqid_4411 |
| variant_5848 | RWKLLKKIPPKFLKSAKKF | seqid_4412 |
| variant_5849 | FWKLLKKIPPKFLKSAKKF | seqid_4413 |
| variant_5850 | KKKKLKKIPPKFLKSAKKF | seqid_4414 |
| variant_5851 | RKKKLKKIPPKFLKSAKKF | seqid_4415 |
| variant_5852 | FKKKLKKIPPKFLKSAKKF | seqid_4416 |
| variant_5853 | KWKKLKKIPPKFLKSAKKF | seqid_4417 |
| variant_5854 | RWKKLKKIPPKFLKSAKKF | seqid_4418 |
| variant_5855 | FWKKLKKIPPKFLKSAKKF | seqid_4419 |
| variant_5904 | KKKLFLKIPKFLKSAKKF | seqid_4420 |
| variant_5905 | RKKLFLKIPKFLKSAKKF | seqid_4421 |
| variant_5906 | FKKLFLKIPKFLKSAKKF | seqid_4422 |
| variant_5907 | KWKLFLKIPKFLKSAKKF | seqid_4423 |
| variant_5908 | RWKLFLKIPKFLKSAKKF | seqid_4424 |
| variant_5909 | FWKLFLKIPKFLKSAKKF | seqid_4425 |
| variant_5910 | KKKKFLKIPKFLKSAKKF | seqid_4426 |
| variant_5911 | RKKKFLKIPKFLKSAKKF | seqid_4427 |
| variant_5912 | FKKKFLKIPKFLKSAKKF | seqid_4428 |
| variant_5913 | KWKKFLKIPKFLKSAKKF | seqid_4429 |
| variant_5914 | RWKKFLKIPKFLKSAKKF | seqid_4430 |
| variant_5915 | FWKKFLKIPKFLKSAKKF | seqid_4431 |
| variant_5916 | KKKLLLKIPKFLKSAKKF | seqid_4432 |
| variant_5917 | RKKLLLKIPKFLKSAKKF | seqid_4433 |
| variant_5918 | FKKLLLKIPKFLKSAKKF | seqid_4434 |
| variant_5919 | KWKLLLKIPKFLKSAKKF | seqid_4435 |
| variant_5920 | RWKLLLKIPKFLKSAKKF | seqid_4436 |
| variant_5921 | FWKLLLKIPKFLKSAKKF | seqid_4437 |
| variant_5922 | KKKKLLKIPKFLKSAKKF | seqid_4438 |
| variant_5923 | RKKKLLKIPKFLKSAKKF | seqid_4439 |
| variant_5924 | FKKKLLKIPKFLKSAKKF | seqid_4440 |
| variant_5925 | KWKKLLKIPKFLKSAKKF | seqid_4441 |
| variant_5926 | RWKKLLKIPKFLKSAKKF | seqid_4442 |

-continued

| | | |
|---|---|---|
| variant_5927 | FWKKLLKIPKFLKSAKKF | seqid_4443 |
| variant_5928 | KKKLFKKIPKFLKSAKKF | seqid_4444 |
| variant_5929 | RKKLFKKIPKFLKSAKKF | seqid_4445 |
| variant_5930 | FKKLFKKIPKFLKSAKKF | seqid_4446 |
| variant_5931 | KWKLFKKIPKFLKSAKKF | seqid_4447 |
| variant_5932 | RWKLFKKIPKFLKSAKKF | seqid_4448 |
| variant_5933 | FWKLFKKIPKFLKSAKKF | seqid_4449 |
| variant_5934 | KKKKFKKIPKFLKSAKKF | seqid_4450 |
| variant_5935 | RKKKFKKIPKFLKSAKKF | seqid_4451 |
| variant_5936 | FKKKFKKIPKFLKSAKKF | seqid_4452 |
| variant_5937 | KWKKFKKIPKFLKSAKKF | seqid_4453 |
| variant_5938 | RWKKFKKIPKFLKSAKKF | seqid_4454 |
| variant_5939 | FWKKFKKIPKFLKSAKKF | seqid_4455 |
| variant_5940 | KKKLLKKIPKFLKSAKKF | seqid_4456 |
| variant_5941 | RKKLLKKIPKFLKSAKKF | seqid_4457 |
| variant_5942 | FKKLLKKIPKFLKSAKKF | seqid_4458 |
| variant_5943 | KWKLLKKIPKFLKSAKKF | seqid_4459 |
| variant_5944 | RWKLLKKIPKFLKSAKKF | seqid_4460 |
| variant_5945 | FWKLLKKIPKFLKSAKKF | seqid_4461 |
| variant_5946 | KKKKLKKIPKFLKSAKKF | seqid_4462 |
| variant_5947 | RKKKLKKIPKFLKSAKKF | seqid_4463 |
| variant_5948 | FKKKLKKIPKFLKSAKKF | seqid_4464 |
| variant_5949 | KWKKLKKIPKFLKSAKKF | seqid_4465 |
| variant_5950 | RWKKLKKIPKFLKSAKKF | seqid_4466 |
| variant_5951 | FWKKLKKIPKFLKSAKKF | seqid_4467 |
| variant_5952 | KKKLFLKIPPPKFKKSAKKF | seqid_4468 |
| variant_5953 | RKKLFLKIPPPKFKKSAKKF | seqid_4469 |
| variant_5954 | FKKLFLKIPPPKFKKSAKKF | seqid_4470 |
| variant_5955 | KWKLFLKIPPPKFKKSAKKF | seqid_4471 |
| variant_5956 | RWKLFLKIPPPKFKKSAKKF | seqid_4472 |
| variant_5957 | FWKLFLKIPPPKFKKSAKKF | seqid_4473 |
| variant_5958 | KKKKFLKIPPPKFKKSAKKF | seqid_4474 |
| variant_5959 | RKKKFLKIPPPKFKKSAKKF | seqid_4475 |
| variant_5960 | FKKKFLKIPPPKFKKSAKKF | seqid_4476 |
| variant_5961 | KWKKFLKIPPPKFKKSAKKF | seqid_4477 |
| variant_5962 | RWKKFLKIPPPKFKKSAKKF | seqid_4478 |
| variant_5963 | FWKKFLKIPPPKFKKSAKKF | seqid_4479 |
| variant_5964 | KKKLLLKIPPPKFKKSAKKF | seqid_4480 |
| variant_5965 | RKKLLLKIPPPKFKKSAKKF | seqid_4481 |
| variant_5966 | FKKLLLKIPPPKFKKSAKKF | seqid_4482 |
| variant_5967 | KWKLLLKIPPPKFKKSAKKF | seqid_4483 |
| variant_5968 | RWKLLLKIPPPKFKKSAKKF | seqid_4484 |
| variant_5969 | FWKLLLKIPPPKFKKSAKKF | seqid_4485 |
| variant_5970 | KKKKLLKIPPPKFKKSAKKF | seqid_4486 |
| variant_5971 | RKKKLLKIPPPKFKKSAKKF | seqid_4487 |
| variant_5972 | FKKKLLKIPPPKFKKSAKKF | seqid_4488 |
| variant_5973 | KWKKLLKIPPPKFKKSAKKF | seqid_4489 |
| variant_5974 | RWKKLLKIPPPKFKKSAKKF | seqid_4490 |
| variant_5975 | FWKKLLKIPPPKFKKSAKKF | seqid_4491 |
| variant_5976 | KKKLFKKIPPPKFKKSAKKF | seqid_4492 |
| variant_5977 | RKKLFKKIPPPKFKKSAKKF | seqid_4493 |
| variant_5978 | FKKLFKKIPPPKFKKSAKKF | seqid_4494 |
| variant_5979 | KWKLFKKIPPPKFKKSAKKF | seqid_4495 |
| variant_5980 | RWKLFKKIPPPKFKKSAKKF | seqid_4496 |
| variant_5981 | FWKLFKKIPPPKFKKSAKKF | seqid_4497 |
| variant_5982 | KKKKFKKIPPPKFKKSAKKF | seqid_4498 |
| variant_5983 | RKKKFKKIPPPKFKKSAKKF | seqid_4499 |
| variant_5984 | FKKKFKKIPPPKFKKSAKKF | seqid_4500 |
| variant_5985 | KWKKFKKIPPPKFKKSAKKF | seqid_4501 |
| variant_5986 | RWKKFKKIPPPKFKKSAKKF | seqid_4502 |
| variant_5987 | FWKKFKKIPPPKFKKSAKKF | seqid_4503 |
| variant_5988 | KKKLLKKIPPPKFKKSAKKF | seqid_4504 |
| variant_5989 | RKKLLKKIPPPKFKKSAKKF | seqid_4505 |
| variant_5990 | FKKLLKKIPPPKFKKSAKKF | seqid_4506 |
| variant_5991 | KWKLLKKIPPPKFKKSAKKF | seqid_4507 |
| variant_5992 | RWKLLKKIPPPKFKKSAKKF | seqid_4508 |
| variant_5993 | FWKLLKKIPPPKFKKSAKKF | seqid_4509 |
| variant_5994 | KKKKLKKIPPPKFKKSAKKF | seqid_4510 |
| variant_5995 | RKKKLKKIPPPKFKKSAKKF | seqid_4511 |
| variant_5996 | FKKKLKKIPPPKFKKSAKKF | seqid_4512 |
| variant_5997 | KWKKLKKIPPPKFKKSAKKF | seqid_4513 |
| variant_5998 | RWKKLKKIPPPKFKKSAKKF | seqid_4514 |
| variant_5999 | FWKKLKKIPPPKFKKSAKKF | seqid_4515 |
| variant_6000 | KKKLFLKIPPKFKKSAKKF | seqid_4516 |
| variant_6001 | RKKLFLKIPPKFKKSAKKF | seqid_4517 |
| variant_6002 | FKKLFLKIPPKFKKSAKKF | seqid_4518 |
| variant_6003 | KWKLFLKIPPKFKKSAKKF | seqid_4519 |
| variant_6004 | RWKLFLKIPPKFKKSAKKF | seqid_4520 |
| variant_6005 | FWKLFLKIPPKFKKSAKKF | seqid_4521 |
| variant_6006 | KKKKFLKIPPKFKKSAKKF | seqid_4522 |
| variant_6007 | RKKKFLKIPPKFKKSAKKF | seqid_4523 |

-continued

| | | |
|---|---|---|
| variant_6008 | FKKKFLKIPPKFKKSAKKF | seqid_4524 |
| variant_6009 | KWKKFLKIPPKFKKSAKKF | seqid_4525 |
| variant_6010 | RWKKFLKIPPKFKKSAKKF | seqid_4526 |
| variant_6011 | FWKKFLKIPPKFKKSAKKF | seqid_4527 |
| variant_6012 | KKKLLLKIPPKFKKSAKKF | seqid_4528 |
| variant_6013 | RKKLLLKIPPKFKKSAKKF | seqid_4529 |
| variant_6014 | FKKLLLKIPPKFKKSAKKF | seqid_4530 |
| variant_6015 | KWKLLLKIPPKFKKSAKKF | seqid_4531 |
| variant_6016 | RWKLLLKIPPKFKKSAKKF | seqid_4532 |
| variant_6017 | FWKLLLKIPPKFKKSAKKF | seqid_4533 |
| variant_6018 | KKKKLLKIPPKFKKSAKKF | seqid_4534 |
| variant_6019 | RKKKLLKIPPKFKKSAKKF | seqid_4535 |
| variant_6020 | FKKKLLKIPPKFKKSAKKF | seqid_4536 |
| variant_6021 | KWKKLLKIPPKFKKSAKKF | seqid_4537 |
| variant_6022 | RWKKLLKIPPKFKKSAKKF | seqid_4538 |
| variant_6023 | FWKKLLKIPPKFKKSAKKF | seqid_4539 |
| variant_6024 | KKKLFKKIPPKFKKSAKKF | seqid_4540 |
| variant_6025 | RKKLFKKIPPKFKKSAKKF | seqid_4541 |
| variant_6026 | FKKLFKKIPPKFKKSAKKF | seqid_4542 |
| variant_6027 | KWKLFKKIPPKFKKSAKKF | seqid_4543 |
| variant_6028 | RWKLFKKIPPKFKKSAKKF | seqid_4544 |
| variant_6029 | FWKLFKKIPPKFKKSAKKF | seqid_4545 |
| variant_6030 | KKKKFKKIPPKFKKSAKKF | seqid_4546 |
| variant_6031 | RKKKFKKIPPKFKKSAKKF | seqid_4547 |
| variant_6032 | FKKKFKKIPPKFKKSAKKF | seqid_4548 |
| variant_6033 | KWKKFKKIPPKFKKSAKKF | seqid_4549 |
| variant_6034 | RWKKFKKIPPKFKKSAKKF | seqid_4550 |
| variant_6035 | FWKKFKKIPPKFKKSAKKF | seqid_4551 |
| variant_6036 | KKKLLKKIPPKFKKSAKKF | seqid_4552 |
| variant_6037 | RKKLLKKIPPKFKKSAKKF | seqid_4553 |
| variant_6038 | FKKLLKKIPPKFKKSAKKF | seqid_4554 |
| variant_6039 | KWKLLKKIPPKFKKSAKKF | seqid_4555 |
| variant_6040 | RWKLLKKIPPKFKKSAKKF | seqid_4556 |
| variant_6041 | FWKLLKKIPPKFKKSAKKF | seqid_4557 |
| variant_6042 | KKKKLKKIPPKFKKSAKKF | seqid_4558 |
| variant_6043 | RKKKLKKIPPKFKKSAKKF | seqid_4559 |
| variant_6044 | FKKKLKKIPPKFKKSAKKF | seqid_4560 |
| variant_6045 | KWKKLKKIPPKFKKSAKKF | seqid_4561 |
| variant_6046 | RWKKLKKIPPKFKKSAKKF | seqid_4562 |
| variant_6047 | FWKKLKKIPPKFKKSAKKF | seqid_4563 |
| variant_6096 | KKKLFLKIPKFKKSAKKF | seqid_4564 |
| variant_6097 | RKKLFLKIPKFKKSAKKF | seqid_4565 |
| variant_6098 | FKKLFLKIPKFKKSAKKF | seqid_4566 |
| variant_6099 | KWKLFLKIPKFKKSAKKF | seqid_4567 |
| variant_6100 | RWKLFLKIPKFKKSAKKF | seqid_4568 |
| variant_6101 | FWKLFLKIPKFKKSAKKF | seqid_4569 |
| variant_6102 | KKKKFLKIPKFKKSAKKF | seqid_4570 |
| variant_6103 | RKKKFLKIPKFKKSAKKF | seqid_4571 |
| variant_6104 | FKKKFLKIPKFKKSAKKF | seqid_4572 |
| variant_6105 | KWKKFLKIPKFKKSAKKF | seqid_4573 |
| variant_6106 | RWKKFLKIPKFKKSAKKF | seqid_4574 |
| variant_6107 | FWKKFLKIPKFKKSAKKF | seqid_4575 |
| variant_6108 | KKKLLLKIPKFKKSAKKF | seqid_4576 |
| variant_6109 | RKKLLLKIPKFKKSAKKF | seqid_4577 |
| variant_6110 | FKKLLLKIPKFKKSAKKF | seqid_4578 |
| variant_6111 | KWKLLLKIPKFKKSAKKF | seqid_4579 |
| variant_6112 | RWKLLLKIPKFKKSAKKF | seqid_4580 |
| variant_6113 | FWKLLLKIPKFKKSAKKF | seqid_4581 |
| variant_6114 | KKKKLLKIPKFKKSAKKF | seqid_4582 |
| variant_6115 | RKKKLLKIPKFKKSAKKF | seqid_4583 |
| variant_6116 | FKKKLLKIPKFKKSAKKF | seqid_4584 |
| variant_6117 | KWKKLLKIPKFKKSAKKF | seqid_4585 |
| variant_6118 | RWKKLLKIPKFKKSAKKF | seqid_4586 |
| variant_6119 | FWKKLLKIPKFKKSAKKF | seqid_4587 |
| variant_6120 | KKKLFKKIPKFKKSAKKF | seqid_4588 |
| variant_6121 | RKKLFKKIPKFKKSAKKF | seqid_4589 |
| variant_6122 | FKKLFKKIPKFKKSAKKF | seqid_4590 |
| variant_6123 | KWKLFKKIPKFKKSAKKF | seqid_4591 |
| variant_6124 | RWKLFKKIPKFKKSAKKF | seqid_4592 |
| variant_6125 | FWKLFKKIPKFKKSAKKF | seqid_4593 |
| variant_6126 | KKKKFKKIPKFKKSAKKF | seqid_4594 |
| variant_6127 | RKKKFKKIPKFKKSAKKF | seqid_4595 |
| variant_6128 | FKKKFKKIPKFKKSAKKF | seqid_4596 |
| variant_6129 | KWKKFKKIPKFKKSAKKF | seqid_4597 |
| variant_6130 | RWKKFKKIPKFKKSAKKF | seqid_4598 |
| variant_6131 | FWKKFKKIPKFKKSAKKF | seqid_4599 |
| variant_6132 | KKKLLKKIPKFKKSAKKF | seqid_4600 |
| variant_6133 | RKKLLKKIPKFKKSAKKF | seqid_4601 |
| variant_6134 | FKKLLKKIPKFKKSAKKF | seqid_4602 |
| variant_6135 | KWKLLKKIPKFKKSAKKF | seqid_4603 |
| variant_6136 | RWKLLKKIPKFKKSAKKF | seqid_4604 |

| variant_6137 | FWKLLKKIPKFKKSAKKF | seqid_4605 |
| variant_6138 | KKKKLKKIPKFKKSAKKF | seqid_4606 |
| variant_6139 | RKKKLKKIPKFKKSAKKF | seqid_4607 |
| variant_6140 | FKKKLKKIPKFKKSAKKF | seqid_4608 |
| variant_6141 | KWKKLKKIPKFKKSAKKF | seqid_4609 |
| variant_6142 | RWKKLKKIPKFKKSAKKF | seqid_4610 |
| variant_6143 | FWKKLKKIPKFKKSAKKF | seqid_4611 |

3.1.2 Sequence motif
$KX_2KX_3X_4X_5KIPX_{11}X_{12}KFLHX_8AKKF$
(SEQ ID NO: 10)

| variant_0 | KLKLLLKIPPPKFLHAAKKF | seqid_4612 |
| variant_1 | KWKLLLKIPPPKFLHAAKKF | seqid_2329 |
| variant_2 | KLKKLLKIPPPKFLHAAKKF | seqid_4613 |
| variant_3 | KWKKLLKIPPPKFLHAAKKF | seqid_2335 |
| variant_4 | KLKLFLKIPPPKFLHAAKKF | seqid_4614 |
| variant_5 | KWKLFLKIPPPKFLHAAKKF | seqid_2317 |
| variant_6 | KLKKFLKIPPPKFLHAAKKF | seqid_4615 |
| variant_7 | KWKKFLKIPPPKFLHAAKKF | seqid_2323 |
| variant_8 | KLKLLKKIPPPKFLHAAKKF | seqid_4616 |
| variant_9 | KWKLLKKIPPPKFLHAAKKF | seqid_2353 |
| variant_10 | KLKKLKKIPPPKFLHAAKKF | seqid_4617 |
| variant_11 | KWKKLKKIPPPKFLHAAKKF | seqid_2359 |
| variant_12 | KLKLFKKIPPPKFLHAAKKF | seqid_4618 |
| variant_13 | KWKLFKKIPPPKFLHAAKKF | seqid_2341 |
| variant_14 | KLKKFKKIPPPKFLHAAKKF | seqid_4619 |
| variant_15 | KWKKFKKIPPPKFLHAAKKF | seqid_2347 |
| variant_16 | KLKLLLKIPPKFLHAAKKF | seqid_4620 |
| variant_17 | KWKLLLKIPPKFLHAAKKF | seqid_2377 |
| variant_18 | KLKKLLKIPPKFLHAAKKF | seqid_4621 |
| variant_19 | KWKKLLKIPPKFLHAAKKF | seqid_2383 |
| variant_20 | KLKLFLKIPPKFLHAAKKF | seqid_4622 |
| variant_21 | KWKLFLKIPPKFLHAAKKF | seqid_2365 |
| variant_22 | KLKKFLKIPPKFLHAAKKF | seqid_4623 |
| variant_23 | KWKKFLKIPPKFLHAAKKF | seqid_2371 |
| variant_24 | KLKLLKKIPPKFLHAAKKF | seqid_4624 |
| variant_25 | KWKLLKKIPPKFLHAAKKF | seqid_2401 |
| variant_26 | KLKKLKKIPPKFLHAAKKF | seqid_4625 |
| variant_27 | KWKKLKKIPPKFLHAAKKF | seqid_2407 |
| variant_28 | KLKLFKKIPPKFLHAAKKF | seqid_4626 |
| variant_29 | KWKLFKKIPPKFLHAAKKF | seqid_2389 |
| variant_30 | KLKKFKKIPPKFLHAAKKF | seqid_4627 |
| variant_31 | KWKKFKKIPPKFLHAAKKF | seqid_2395 |
| variant_48 | KLKLLLKIPKFLHAAKKF | seqid_4628 |
| variant_49 | KWKLLLKIPKFLHAAKKF | seqid_2424 |
| variant_50 | KLKKLLKIPKFLHAAKKF | seqid_4629 |
| variant_51 | KWKKLLKIPKFLHAAKKF | seqid_9 |
| variant_52 | KLKLFLKIPKFLHAAKKF | seqid_4630 |
| variant_53 | KWKLFLKIPKFLHAAKKF | seqid_2413 |
| variant_54 | KLKKFLKIPKFLHAAKKF | seqid_4631 |
| variant_55 | KWKKFLKIPKFLHAAKKF | seqid_8 |
| variant_56 | KLKLLKKIPKFLHAAKKF | seqid_4632 |
| variant_57 | KWKLLKKIPKFLHAAKKF | seqid_2445 |
| variant_58 | KLKKLKKIPKFLHAAKKF | seqid_4633 |
| variant_59 | KWKKLKKIPKFLHAAKKF | seqid_2451 |
| variant_60 | KLKLFKKIPKFLHAAKKF | seqid_4634 |
| variant_61 | KWKLFKKIPKFLHAAKKF | seqid_7 |
| variant_62 | KLKKFKKIPKFLHAAKKF | seqid_4635 |
| variant_63 | KWKKFKKIPKFLHAAKKF | seqid_2439 |
| variant_64 | KLKLLLKIPPPKFLHVAKKF | seqid_4636 |
| variant_65 | KWKLLLKIPPPKFLHVAKKF | seqid_3475 |
| variant_66 | KLKKLLKIPPPKFLHVAKKF | seqid_4637 |
| variant_67 | KWKKLLKIPPPKFLHVAKKF | seqid_3481 |
| variant_68 | KLKLFLKIPPPKFLHVAKKF | seqid_4638 |
| variant_69 | KWKLFLKIPPPKFLHVAKKF | seqid_3463 |
| variant_70 | KLKKFLKIPPPKFLHVAKKF | seqid_4639 |
| variant_71 | KWKKFLKIPPPKFLHVAKKF | seqid_3469 |
| variant_72 | KLKLLKKIPPPKFLHVAKKF | seqid_4640 |
| variant_73 | KWKLLKKIPPPKFLHVAKKF | seqid_3499 |
| variant_74 | KLKKLKKIPPPKFLHVAKKF | seqid_4641 |
| variant_75 | KWKKLKKIPPPKFLHVAKKF | seqid_3505 |
| variant_76 | KLKLFKKIPPPKFLHVAKKF | seqid_4642 |
| variant_77 | KWKLFKKIPPPKFLHVAKKF | seqid_3487 |
| variant_78 | KLKKFKKIPPPKFLHVAKKF | seqid_4643 |
| variant_79 | KWKKFKKIPPPKFLHVAKKF | seqid_3493 |
| variant_80 | KLKLLLKIPPKFLHVAKKF | seqid_4644 |
| variant_81 | KWKLLLKIPPKFLHVAKKF | seqid_3523 |
| variant_82 | KLKKLLKIPPKFLHVAKKF | seqid_4645 |
| variant_83 | KWKKLLKIPPKFLHVAKKF | seqid_3529 |
| variant_84 | KLKLFLKIPPKFLHVAKKF | seqid_4646 |
| variant_85 | KWKLFLKIPPKFLHVAKKF | seqid_3511 |
| variant_86 | KLKKFLKIPPKFLHVAKKF | seqid_4647 |
| variant_87 | KWKKFLKIPPKFLHVAKKF | seqid_3517 |

| | | |
|---|---|---|
| variant_88 | KLKLLKKIPPKFLHVAKKF | seqid_4648 |
| variant_89 | KWKLLKKIPPKFLHVAKKF | seqid_3547 |
| variant_90 | KLKKLKKIPPKFLHVAKKF | seqid_4649 |
| variant_91 | KWKKLKKIPPKFLHVAKKF | seqid_3553 |
| variant_92 | KLKLFKKIPPKFLHVAKKF | seqid_4650 |
| variant_93 | KWKLFKKIPPKFLHVAKKF | seqid_3535 |
| variant_94 | KLKKFKKIPPKFLHVAKKF | seqid_4651 |
| variant_95 | KWKKFKKIPPKFLHVAKKF | seqid_3541 |
| variant_112 | KLKLLLKIPKFLHVAKKF | seqid_4652 |
| variant_113 | KWKLLLKIPKFLHVAKKF | seqid_3571 |
| variant_114 | KLKKLLKIPKFLHVAKKF | seqid_4653 |
| variant_115 | KWKKLLKIPKFLHVAKKF | seqid_3577 |
| variant_116 | KLKLFLKIPKFLHVAKKF | seqid_4654 |
| variant_117 | KWKLFLKIPKFLHVAKKF | seqid_3559 |
| variant_118 | KLKKFLKIPKFLHVAKKF | seqid_4655 |
| variant_119 | KWKKFLKIPKFLHVAKKF | seqid_3565 |
| variant_120 | KLKLLKKIPKFLHVAKKF | seqid_4656 |
| variant_121 | KWKLLKKIPKFLHVAKKF | seqid_3595 |
| variant_122 | KLKKLKKIPKFLHVAKKF | seqid_4657 |
| variant_123 | KWKKLKKIPKFLHVAKKF | seqid_3601 |
| variant_124 | KLKLFKKIPKFLHVAKKF | seqid_4658 |
| variant_125 | KWKLFKKIPKFLHVAKKF | seqid_3583 |
| variant_126 | KLKKFKKIPKFLHVAKKF | seqid_4659 |
| variant_127 | KWKKFKKIPKFLHVAKKF | seqid_3589 |
| variant_128 | KLKLLLKIPPPKFLHLAKKF | seqid_4660 |
| variant_129 | KWKLLLKIPPPKFLHLAKKF | seqid_2901 |
| variant_130 | KLKKLLKIPPPKFLHLAKKF | seqid_4661 |
| variant_131 | KWKKLLKIPPPKFLHLAKKF | seqid_2907 |
| variant_132 | KLKLFLKIPPPKFLHLAKKF | seqid_4662 |
| variant_133 | KWKLFLKIPPPKFLHLAKKF | seqid_2889 |
| variant_134 | KLKKFLKIPPPKFLHLAKKF | seqid_4663 |
| variant_135 | KWKKFLKIPPPKFLHLAKKF | seqid_2895 |
| variant_136 | KLKLLKKIPPPKFLHLAKKF | seqid_4664 |
| variant_137 | KWKLLKKIPPPKFLHLAKKF | seqid_2925 |
| variant_138 | KLKKLKKIPPPKFLHLAKKF | seqid_4665 |
| variant_139 | KWKKLKKIPPPKFLHLAKKF | seqid_2931 |
| variant_140 | KLKLFKKIPPPKFLHLAKKF | seqid_4666 |
| variant_141 | KWKLFKKIPPPKFLHLAKKF | seqid_2913 |
| variant_142 | KLKKFKKIPPPKFLHLAKKF | seqid_4667 |
| variant_143 | KWKKFKKIPPPKFLHLAKKF | seqid_2919 |
| variant_144 | KLKLLLKIPPKFLHLAKKF | seqid_4668 |
| variant_145 | KWKLLLKIPPKFLHLAKKF | seqid_2949 |
| variant_146 | KLKKLLKIPPKFLHLAKKF | seqid_4669 |
| variant_147 | KWKKLLKIPPKFLHLAKKF | seqid_2955 |
| variant_148 | KLKLFLKIPPKFLHLAKKF | seqid_4670 |
| variant_149 | KWKLFLKIPPKFLHLAKKF | seqid_2937 |
| variant_150 | KLKKFLKIPPKFLHLAKKF | seqid_4671 |
| variant_151 | KWKKFLKIPPKFLHLAKKF | seqid_2943 |
| variant_152 | KLKLLKKIPPKFLHLAKKF | seqid_4672 |
| variant_153 | KWKLLKKIPPKFLHLAKKF | seqid_2973 |
| variant_154 | KLKKLKKIPPKFLHLAKKF | seqid_4673 |
| variant_155 | KWKKLKKIPPKFLHLAKKF | seqid_2979 |
| variant_156 | KLKLFKKIPPKFLHLAKKF | seqid_4674 |
| variant_157 | KWKLFKKIPPKFLHLAKKF | seqid_2961 |
| variant_158 | KLKKFKKIPPKFLHLAKKF | seqid_4675 |
| variant_159 | KWKKFKKIPPKFLHLAKKF | seqid_2967 |
| variant_176 | KLKLLLKIPKFLHLAKKF | seqid_4676 |
| variant_177 | KWKLLLKIPKFLHLAKKF | seqid_2997 |
| variant_178 | KLKKLLKIPKFLHLAKKF | seqid_4677 |
| variant_179 | KWKKLLKIPKFLHLAKKF | seqid_3003 |
| variant_180 | KLKLFLKIPKFLHLAKKF | seqid_4678 |
| variant_181 | KWKLFLKIPKFLHLAKKF | seqid_2985 |
| variant_182 | KLKKFLKIPKFLHLAKKF | seqid_4679 |
| variant_183 | KWKKFLKIPKFLHLAKKF | seqid_2991 |
| variant_184 | KLKLLKKIPKFLHLAKKF | seqid_4680 |
| variant_185 | KWKLLKKIPKFLHLAKKF | seqid_3019 |
| variant_186 | KLKKLKKIPKFLHLAKKF | seqid_4681 |
| variant_187 | KWKKLKKIPKFLHLAKKF | seqid_3025 |
| variant_188 | KLKLFKKIPKFLHLAKKF | seqid_4682 |
| variant_189 | KWKLFKKIPKFLHLAKKF | seqid_3 |
| variant_190 | KLKKFKKIPKFLHLAKKF | seqid_4683 |
| variant_191 | KWKKFKKIPKFLHLAKKF | seqid_3013 |
| variant_192 | KLKLLLKIPPPKFLHSAKKF | seqid_4684 |
| variant_193 | KWKLLLKIPPPKFLHSAKKF | seqid_4051 |
| variant_194 | KLKKLLKIPPPKFLHSAKKF | seqid_4685 |
| variant_195 | KWKKLLKIPPPKFLHSAKKF | seqid_4057 |
| variant_196 | KLKLFLKIPPPKFLHSAKKF | seqid_4686 |
| variant_197 | KWKLFLKIPPPKFLHSAKKF | seqid_4039 |
| variant_198 | KLKKFLKIPPPKFLHSAKKF | seqid_4687 |
| variant_199 | KWKKFLKIPPPKFLHSAKKF | seqid_4045 |
| variant_200 | KLKLLKKIPPPKFLHSAKKF | seqid_4688 |

```
variant_201    KWKLLKKIPPPKFLHSAKKF    seqid_4075
variant_202    KLKKLKKIPPPKFLHSAKKF    seqid_4689
variant_203    KWKKLKKIPPPKFLHSAKKF    seqid_4081
variant_204    KLKLFKKIPPPKFLHSAKKF    seqid_4690
variant_205    KWKLFKKIPPPKFLHSAKKF    seqid_4063
variant_206    KLKKFKKIPPPKFLHSAKKF    seqid_4691
variant_207    KWKKFKKIPPPKFLHSAKKF    seqid_4069
variant_208    KLKLLLKIPPKFLHSAKKF     seqid_4692
variant_209    KWKLLLKIPPKFLHSAKKF     seqid_4099
variant_210    KLKKLLKIPPKFLHSAKKF     seqid_4693
variant_211    KWKKLLKIPPKFLHSAKKF     seqid_4105
variant_212    KLKLFLKIPPKFLHSAKKF     seqid_4694
variant_213    KWKLFLKIPPKFLHSAKKF     seqid_4087
variant_214    KLKKFLKIPPKFLHSAKKF     seqid_4695
variant_215    KWKKFLKIPPKFLHSAKKF     seqid_4093
variant_216    KLKLLKKIPPKFLHSAKKF     seqid_4696
variant_217    KWKLLKKIPPKFLHSAKKF     seqid_4123
variant_218    KLKKLKKIPPKFLHSAKKF     seqid_4697
variant_219    KWKKLKKIPPKFLHSAKKF     seqid_4129
variant_220    KLKLFKKIPPKFLHSAKKF     seqid_4698
variant_221    KWKLFKKIPPKFLHSAKKF     seqid_4111
variant_222    KLKKFKKIPPKFLHSAKKF     seqid_4699
variant_223    KWKKFKKIPPKFLHSAKKF     seqid_4117
variant_240    KLKLLLKIPKFLHSAKKF      seqid_4700
variant_241    KWKLLLKIPKFLHSAKKF      seqid_4147
variant_242    KLKKLLKIPKFLHSAKKF      seqid_4701
variant_243    KWKKLLKIPKFLHSAKKF      seqid_4153
variant_244    KLKLFLKIPKFLHSAKKF      seqid_4702
variant_245    KWKLFLKIPKFLHSAKKF      seqid_4135
variant_246    KLKKFLKIPKFLHSAKKF      seqid_4703
variant_247    KWKKFLKIPKFLHSAKKF      seqid_4141
variant_248    KLKLLKKIPKFLHSAKKF      seqid_4704
variant_249    KLNKLLKKIPKFLHSAKKF     seqid_4171
variant_250    KLKKLKKIPKFLHSAKKF      seqid_4705
variant_251    KWKKLKKIPKFLHSAKKF      seqid_4177
variant_252    KLKLFKKIPKFLHSAKKF      seqid_4706
variant_253    KWKLFKKIPKFLHSAKKF      seqid_4708
variant_254    KLKKFKKIPKFLHSAKKF      seqid_4707
variant_255    KWKKFKKIPKFLHSAKKF      seqid_4165
```

3.1.3 Sequence Motif HEL1-HB-HEL2

As further non-limiting examples there may be mentioned:

```
Variant_1     KWKLFKKIGPKFLHLAKKF-NH2         SEQ ID NO: 4709
Variant_2     KWKLFKKGPGKFLHSAKKF-NH2         SEQ ID NO: 4710
Variant_3     KWKLFKKIEKVGQGPGKFLHSAKKFG-NH2  SEQ ID NO: 4711
Variant_4     WKLFKKIPKFLHLAKKF-NH2           SEQ ID NO: 4712
Variant_5     FKLFLLIPKFLHLAKKF-NH2           SEQ ID NO: 4713
Variant_6     KWFKKIPKFLHLAKKF-NH2            SEQ ID NO: 4714
Variant_7     WFKKIPKFLHLAKKF-NH2             SEQ ID NO: 4715
Variant_8     KWKKIPKFLHLLKKF-NH2             SEQ ID NO: 4716
Variant_9     WFKKIPKFLHLLKKF-NH2             SEQ ID NO: 4717
Variant_10    KWKLFKKIPFLHLAKKF-NH2           SEQ ID NO: 4718
Variant_11    KWKLFKKIPKFLHLAKK-NH2           SEQ ID NO: 4719
Variant_12    KWKLFKKIPLHLAKKF-NH2            SEQ ID NO: 4720
Variant_13    KWKLFKKIPKFLHLAK-NH2            SEQ ID NO: 4721
Variant_14    KWKLFKKIPHLAKKF-NH2             SEQ ID NO: 4722
Variant_15    KWKLFKKIPKFLHLA-NH2             SEQ ID NO: 4723
Variant_16    KWKLFKKIPLAKKF-NH2              SEQ ID NO: 4724
```

-continued

| | | |
|---|---|---|
| Variant_17 | KWKLFKKIPKFLHL-NH₂ | SEQ ID NO: 4725 |
| Variant_18 | FKKALHLFKPIKKFLKWK-NH₂ | SEQ ID NO: 4726 |
| Variant_19 | KFLHLAKKFPKWKLFKKI-NH₂ | SEQ ID NO: 4727 |
| Variant_20 | KWKKLLKKPLLKKLLKKL-NH₂ | SEQ ID NO: 4728 |
| Variant_21 | KWKLKPLLKKLLKKL-NH₂ | SEQ ID NO: 4729 |
| Variant_22 | KWKKLLKKPLKLKL-NH₂ | SEQ ID NO: 4730 |
| Variant_23 | KLLKKPLKLKL-NH₂ | SEQ ID NO: 4731 |

Also comprised by the present invention are the above sequences, wherein, however, the C-terminal end is not amidated and, consequently, such sequences, terminated by a carboxy group (in the form of its salt or as free acid).

3.1.4 Modifications of SEQ ID NO:3

In these modifications the peptide according to SEQ ID NO:3 is elongated by any arbitrary amino acid residue on its N-terminal and/or C-terminal end. Non-limiting examples of additional residues comprise Asp, Pro, Asn and Gly. If the N- and the C-terminal end is elongated simultaneously the additional N-terminal residue preferably is Pro or Gly and the corresponding C-terminal residue is Asp and Asn, respectively.

As further non-limiting examples there may be mentioned:

| | |
|---|---|
| PKWKLFKKIPKFLHLAKKF-NH₂ | (SEQ ID NO: 4732) |
| KWKLFKKIPKFLHLAKKFD-NH₂ | (SEQ ID NO: 4733) |
| PKWKLFKKIPKFLHLAKKFD-NH₂ | (SEQ ID NO: 4734) |
| GKWKLFKKIPKFLHLAKKF-NH₂ | (SEQ ID NO: 4735) |
| KWKLFKKIPKFLHLAKKFN-NH₂ | (SEQ ID NO: 4736) |
| GKWKLFKKIPKFLHLAKKFN-NH₂ | (SEQ ID NO: 4737) |
| PKWKLFKKIPKFLHLAKKFN-NH₂ | (SEQ ID NO: 4738) |

Also comprised are the above sequences wherein the C-terminal end is not amidated, and, consequently, sequences which are terminated by a carboxy group (in the form of its salt or free acid).

3.2 Further Modifications of Peptides According to the Invention

Besides the peptide sequences depicted above, preference is also given to functional equivalents, functional derivatives and salts of this sequence.

According to the invention, "functional equivalents" is also understood in particular as meaning mutants which, in at least one sequence position of the abovementioned amino acid sequences, have an amino acid other than the one specifically specified, but nevertheless have the property of preventing, inhibiting and treating dandruff. "Functional equivalents" thus include the mutants obtainable by one or more amino acid additions, substitutions, deletions and/or inversions, where said changes can occur in any sequence position provided they lead to a mutant with the profile of properties according to the invention. Functional equivalence exists in particular also when the reactivity patterns between mutant and unmodified polypeptide are in qualitative agreement.

"Functional equivalents" in the above sense are also "precursors" of the polypeptides described and also "functional derivatives" and "salts" of the polypeptides.

"Precursors" here are natural or synthetic precursors of the polypeptides with or without the desired biological activity.

Examples of suitable amino acid substitutions are given in the table below:

| Original residue | Examples of substitution |
|---|---|
| Ala | Ser |
| Arg | Lys |
| Asn | Gln; His |
| Asp | Glu |
| Cys | Ser |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

The expression "salts" is understood as meaning both salts of carboxyl groups and also acid addition salts of amino groups of the peptide molecules according to the invention. Salts of carboxyl groups can be produced in a manner known per se and comprise inorganic salts, such as, for example, sodium, calcium, ammonium, iron and zinc salts, and also salts with organic bases, such as, for example, amines, such as triethanolamine, arginine, lysine, piperidine and the like. Acid addition salts, such as, for example, salts with mineral acids, such as hydrochloric acid or sulfuric acid and salts with organic acids, such as acetic acid and oxalic acid, are likewise provided by the invention.

"Functional derivatives" (or "derivatives") of polypeptides according to the invention can likewise be produced on functional amino acid side groups or on their N or C terminal end using known techniques. Such derivatives comprise, for example, aliphatic esters of carboxylic acid groups, amides of carboxylic acid groups obtainable by reaction with ammonia or with a primary or secondary amine; N-acyl derivatives of free amino groups, prepared by reaction with acyl groups, or O-acyl derivatives of free hydroxy groups, prepared by reaction with acyl groups. Furthermore, 1 to 5, such as, for example, 2, 3 or 4, arbitrary D- or L-amino acid residues can additionally be covalently (peptidically) bonded at the N and/or C terminal end; or 1 to 5, as for example 1, 2, 3 or 4 residues may be missing at the N-terminal and/or C-terminal end.

Non-limiting examples of additional N-terminal and/or C-terminal residues comprise Asp, Pro, Asn, Gly. In case the N-terminal end and the C-terminal end are simultaneously elongated, the N-terminal residue may preferably be Pro or Gly and the corresponding C-terminal residue may preferably be Asp and Asn, respectively.

Through variation of the amino acid sequence of the described antimicrobial peptides and fusing with additional protein or peptide sequences, it is possible to generate structures which specifically recognize certain surfaces, e.g. skin, nails, hair, or are recognized and bonded by these surfaces or the receptors present therein.

Consequently, it is possible to more effectively bring the described antimicrobial peptides to the desired site of action, and/or to improve their absorption. Through coupling and/or fusion of binding proteins to the described antimicrobial peptides, protein-peptide fusion products resulting therefrom would be steered in a more targeted manner to appropriate sites of action, e.g. microorganism surfaces or body compartments, and/or reside longer at these sites, resulting in an extended and improved peptide effect. Furthermore, through variation of the amino acid sequence of the described antimicrobial peptides and/or fusion with additional protein or peptide sequences, it is possible to steer the peptides to desired sites of action in a targeted manner in order to thus achieve, for example, higher peptide specificity, lower peptide consumption or peptide dose, and also more rapid or greater peptide effect.

3.3 Nucleic Acids, Expression Constructs, Vectors and Microorganisms According to the Invention 3.3.1 Nucleic Acids:

The invention furthermore comprises the nucleic acid molecules coding for the peptides and fusion peptides used according to the invention.

All of the nucleic acid sequences mentioned herein (single- and double-strand DNA and RNA sequences, such as, for example, cDNA and mRNA) can be prepared in a manner known per se by chemical synthesis from the nucleotide building blocks, such as, for example, by fragment condensation of individual overlapping, complementary nucleic acid building blocks of the double helix. The chemical synthesis of oligonucleotides can take place, for example, in a known manner according to the phosphoamidite method (Voet, Voet, $2^{nd}$ edition, Wiley Press New York, pages 896-897). The annealing of synthetic oligonucleotides and filling in of gaps with the aid of the Klenow fragment of DNA polymerase, and ligation reactions and also general cloning methods are described in Sambrook et al. (1989), Molecular Cloning: A laboratory manual, Cold Spring Harbor Laboratory Press.

The invention provides both isolated nucleic acid molecules which code for polypeptides or proteins according to the invention, or biologically active sections thereof, and to nucleic acid fragments which can be used, for example, as hybridization probes or primers for the identification or amplification of coding nucleic acids according to the invention.

The nucleic acid molecules according to the invention can additionally comprise untranslated sequences of the 3' and/or 5' end of the coding region of the gene.

An "isolated" nucleic acid molecule is separated off from other nucleic acid molecules which are present in the natural source of the nucleic acid and can, moreover, be essentially free of other cellular material or culture medium if produced by recombinant techniques, or be free of chemical precursors or other chemicals if chemically synthesized.

A nucleic acid molecule according to the invention can be isolated by means of standard molecular biology techniques and the sequence information provided according to the invention. For example, cDNA can be isolated from a suitable cDNA library by using one of the specifically disclosed complete sequences or a section thereof as hybridization probe and standard hybridization techniques (as described, for example, in Sambrook, J., Fritsch, E. F. and Maniatis, T. Molecular Cloning: A Laboratory Manual. 2nd edition, Cold Spring Harbor Laboratory, Cold Spring Harbor Laboratory Press, Cold Spring Harbor, N.Y., 1989). Moreover, a nucleic acid molecule comprising one of the disclosed sequences or a section thereof can be isolated by polymerase chain reaction using the oligonucleotide primers generated on the basis of this sequence. The nucleic acid amplified in this way can be cloned into a suitable vector and characterized by DNA sequence analysis. The oligonucleotides according to the invention can also be prepared by standard synthesis methods, e.g. using an automatic DNA synthesizer.

The invention furthermore comprises the nucleic acid molecules complementary to the specifically described nucleotide sequences, or a section thereof.

The nucleotide sequences according to the invention allow the generation of probes and primers which can be used for the identification and/or cloning of homologous sequences in other cell types and organisms. Such probes and primers usually comprise a nucleotide sequence range which, under stringent conditions, hybridizes to at least about 12, preferably at least about 25, such as, for example, about 40, 50 or 75, consecutive nucleotides of a sense strand of a nucleic acid sequence according to the invention or of a corresponding antisense strand.

Also comprised according to the invention are those nucleic acid sequences which comprise so-called silent mutations or which are modified, compared to a specifically specified sequence, according to the codon usage of a specific source organism or host organism, as are naturally occurring variants, such as, for example, splice variants or allelic variants, thereof. Likewise provided are sequences obtainable by conservative nucleotide substitutions (i.e. the amino acid in question is replaced by an amino acid of identical charge, size, polarity and/or solubility).

The invention also provides the molecules derived from the specifically disclosed nucleic acids by sequence polymorphisms. These genetic polymorphisms can exist between individuals within a population, owing to natural variation. These natural variations usually bring about a variance of from 1 to 5% in the nucleotide sequence of a gene.

Furthermore, the invention also comprises nucleic acid sequences which hybridize with the abovementioned coding sequences or are complementary thereto. These polynucleotides can be found when screening genomic or cDNA libraries and, if appropriate, be replicated therefrom by means of PCR using suitable primers and then isolated using suitable probes, for example. A further possibility is the transformation of suitable microorganisms with polynucleotides or vectors according to the invention, replication of the microorganisms and thus of the polynucleotides and subsequent isolation thereof. Moreover, polynucleotides according to the invention can also be synthesized by a chemical method.

The property of being able to "hybridize" to polynucleotides is understood as meaning the ability of a poly- or oligonucleotide, to bind, under stringent conditions, to a virtually complementary sequence while nonspecific bonds between noncomplementary partners do not take place under these conditions. For this purpose, the sequences should be 70-100%, preferably 90-100%, complementary. The property of complementary sequences of being able to bind specifically to one another is utilized, for example, in the Northern or Southern blot technique or during primer binding in PCR or RT-PCR. Usually, for this purpose, oligonucleotides above a length of 30 base pairs are used. Stringent conditions are understood as meaning, for example in the Northern blot technique, the use of a 50-70° C., preferably 60-65° C. hot washing solution, for example 0.1×SSC buffer with 0.1% SDS (20×SSC: 3 M NaCl, 0.3 M Na citrate, pH 7.0) for the elution of nonspecific hybridized cDNA probes or oligonucleotides. As mentioned above, in this process, only highly complementary nucleic acids remain bound to one another. Establishing stringent conditions is known to the person skilled in the art and is described, for example, in Ausubel et al., Current Protocols in Molecular Biology, John Wiley & Sons, N.Y. (1989), 6.3.1-6.3.6.

3.3.2 Expression Constructs and Vectors:

The invention moreover provides expression constructs comprising, under the genetic control of regulatory nucleic acid sequences, a nucleic acid sequence coding for a polypeptide according to the invention, and also vectors comprising at least one of these expression constructs. Preferably, such constructs according to the invention comprise a promoter 5' upstream of the particular coding sequence and a terminator sequence 3' downstream and also, if appropriate, further customary regulatory elements, in each case operatively linked to the coding sequence. An "operative linkage" is understood as meaning the sequential arrangement of promoter, coding sequence, terminator and, if appropriate further regulatory elements such that each of the regulatory elements can perform its function during the expression of the coding sequence as intended. Examples of operatively linkable sequences are targeting sequences and also enhancers, polyadenylation signals and the like. Further regulatory elements comprise selectable markers, amplification signals, replication origins and the like. Suitable regulatory sequences are described, for example, in Goeddel, Gene Expression Technology: Methods in Enzymology 185, Academic Press, San Diego, Calif. (1990).

In addition to the artificial regulatory sequences, the natural regulatory sequence may still be present upstream of the actual structural gene. Through genetic modification, this natural regulation can, if appropriate, be switched off and the expression of the genes increased or decreased. However, the gene construct can also be simpler in design, i.e. no additional regulatory signals are inserted upstream of the structure gene and the natural promoter together with its regulation is not removed. Instead, the natural regulatory sequence is mutated such that regulation no longer takes place and gene expression is increased or reduced. The nucleic acid sequences may be present in one or more copies in the gene construct.

Examples of promoters that can be used are: cos, tac, trp, tet, trp-tet, lpp, lac, lpp-lac, lacIq, T7, T5, T3, gal, trc, ara, SP6, lambda-P$_R$ or in the lambda-P$_L$ promoter, which are advantageously used in Gram-negative bacteria; and also the Gram-positive promoters amy and SPO2, the yeast promoters ADC1, MFa, AC, P-60, CYC1, GAPDH or the plant promoters CaMV/35S, SSU, OCS, lib4, usp, STLS1, B33, not or the ubiquitin or phaseolin promoter. Particular preference is given to using inducible promoters, such as, for example, photo- and in particular temperature-inducible promoters, such as the P$_r$P$_l$ promoter. In principle, all natural promoters with their regulatory sequences can be used. Moreover, synthetic promoters can also be used advantageously.

The specified regulatory sequences are intended to permit the targeted expression of the nucleic acid sequences and protein expression. Depending on the host organism, this may mean, for example, that the gene is expressed or overexpressed only after induction, or that it is immediately expressed and/or overexpressed.

The regulatory sequences or factors can here preferably have a beneficial effect on, and thereby increase or decrease, the expression. Thus, the regulatory elements can advantageously be enhanced at the transcriptional level by using strong transcription signals such as promoters and/or "enhancers". However, in addition, it is also possible to enhance translation by, for example, improving the stability of the mRNA.

The expression cassette is prepared by fusing a suitable promoter with a suitable coding nucleotide sequence and a terminator signal or polyadenylation signal. For this purpose, customary recombinant and cloning techniques are used, as are described, for example, in T. Maniatis, E. F. Fritsch and J. Sambrook, Molecular Cloning: A Laboratory Manual, Cold Spring Harbor Laboratory, Cold Spring Harbor, N.Y. (1989) and in T. J. Silhavy, M. L. Berman and L. W. Enquist, Experiments with Gene Fusions, Cold Spring Harbor Laboratory, Cold Spring Harbor, N.Y. (1984) and in Ausubel, F. M. et al., Current Protocols in Molecular Biology, Greene Publishing Assoc. and Wiley Interscience (1987).

For expression, the recombinant nucleic acid construct or gene construct is advantageously inserted, in a suitable host organism, into a host-specific vector which facilitates optimal expression of the genes in the host. Vectors are well known to the person skilled in the art and can be found, for example, in "Cloning Vectors" (Pouwels P. H. et al., ed., Elsevier, Amsterdam-New York-Oxford, 1985). Apart from plasmids, vectors are also to be understood as meaning all other vectors known to the person skilled in the art, such as, for example, phages, viruses, such as SV40, CMV, baculovirus and adenovirus, transposons, IS elements, phasmids, cosmids, and linear or circular DNA. These vectors can be replicated autonomously in the host organism or be replicated chromosomally.

3.3.3 Examples of Suitable Expression Vectors which May be Mentioned are:

Customary fusion expression vectors, such as pGEX (Pharmacia Biotech Inc; Smith, D. B. and Johnson, K. S. (1988) Gene 67:31-40), pMAL (New England Biolabs, Beverly, Mass.) and pRIT 5 (Pharmacia, Piscataway, N.J.), in which glutathione-5-transferase (GST), maltose E binding protein or protein A is fused to the recombinant target protein.

Non-fusion protein expression vectors such as pTrc (Amann et al., (1988) Gene 69:301-315) and pET 11d (Studier et al. Gene Expression Technology: Methods in Enzymology 185, Academic Press, San Diego, Calif. (1990) 60-89).

Yeast expression vectors for expression in the yeast *S. cerevisiae*, such as pYepSec1 (Baldari et al., (1987) Embo J. 6:229-234), pMFa (Kurjan and Herskowitz (1982) Cell 30:933-943), pJRY88 (Schultz et al., (1987) Gene 54:113-123) and pYES2 (Invitrogen Corporation, San Diego, Calif.). Vectors and methods for the construction of vectors which are suitable for use in other fungi, such as filamentous fungi, comprise those which are described in detail in: van den Hondel, C. A. M. J. J. & Punt, P. J. (1991) "Gene transfer systems and vector development for filamentous fungi, in: Applied Molecular Genetics of Fungi, J. F. Peberdy et al., eds., S. 1-28, Cambridge University Press: Cambridge.

Baculovirus vectors which are available for the expression of proteins in cultivated insect cells (for example Sf9 cells) comprise the pAc series (Smith et al., (1983) Mol. Cell. Biol. 3:2156-2165) and the pVL series (Lucklow and Summers, (1989) Virology 170:31-39).

Plant expression vectors, such as those described in detail in: Becker, D., Kemper, E., Schell, J. and Masterson, R. (1992) "New plant binary vectors with selectable markers located proximal to the left border", Plant Mol. Biol.

20:1195-1197; and Bevan, M. W. (1984) "Binary *Agrobacterium* vectors for plant transformation", Nucl. Acids Res. 12:8711-8721.

Mammal expression vectors, such as pCDM8 (Seed, B. (1987) Nature 329:840) and pMT2PC (Kaufman et al. (1987) EMBO J. 6:187-195).

Further suitable expression systems for prokaryotic and eukaryotic cells are described in chapter 16 and 17 by Sambrook, J., Fritsch, E. F. and Maniatis, T., Molecular cloning: A Laboratory Manual, 2nd edition, Cold Spring Harbor Laboratory, Cold Spring Harbor Laboratory Press, Cold Spring Harbor, N.Y., 1989.

3.3.4 Recombinant Microorganisms:

With the aid of the vectors according to the invention it is possible to prepare recombinant microorganisms which are transformed, for example, with at least one vector according to the invention and can be used for producing the polypeptides according to the invention. The abovedescribed recombinant constructs according to the invention are advantageously introduced into a suitable host system and expressed. In this context, preference is given to using customary cloning and transfection methods known to the person skilled in the art such as, for example, coprecipitation, protoplast fusion, electroporation, retroviral transfection and the like, in order to express said nucleic acids in the particular expression system. Suitable systems are described, for example, in Current Protocols in Molecular Biology, F. Ausubel et al., ed., Wiley Interscience, New York 1997, or Sambrook et al., Molecular Cloning: A Laboratory Manual. 2nd edition, Cold Spring Harbor Laboratory, Cold Spring Harbor Laboratory Press, Cold Spring Harbor, N.Y., 1989.

According to the invention, it is also possible to prepare homologously recombinant microorganisms. For this, a vector is prepared which comprises at least one section of a gene according to the invention or of a coding sequence, into which, if appropriate, at least one amino acid deletion, addition or substitution has been introduced in order to modify, for example to functionally disrupt, the sequence according to the invention ("knockout" vector). The introduced sequence may, for example, also be a homolog from a related microorganism or be derived from a mammalian, yeast or insect source. Alternatively, the vector used for homologous recombination may be designed such that the endogenous gene is mutated or otherwise modified upon homologous recombination, while still encoding the functional protein (for example the upstream regulatory region may be modified in such a way that, as a result, the expression of the endogenous protein is modified). The modified section of the gene according to the invention is in the homologous recombination vector. The construction of suitable vectors for homologous recombination is described, for example, in Thomas, K. R. and Capecchi, M. R. (1987) Cell 51:503.

Suitable host organisms are in principle all organisms which permit an expression of the nucleic acids according to the invention, their allelic variants, their functional equivalents or derivatives. Host organisms are to be understood as meaning, for example, bacteria, fungi, yeasts, plant or animal cells. Preferred organisms are bacteria, such as those of the genera *Escherichia*, such as, for example, *Escherichia coli*, *Streptomyces*, *Bacillus* or *Pseudomonas*, eukaryotic microorganisms, such as *Saccharomyces cerevisiae, Aspergillus*, higher eukaryotic cells from animals or plants, for example Sf9 or CHO cells.

The selection of successfully transformed organisms can take place by marker genes which are likewise present in the vector or in the expression cassette. Examples of such marker genes are genes for antibiotic resistance and for enzymes which catalyze a color-imparting reaction, which results in staining of the transformed cell. These can then be selected by automatic cell sorting. Microorganisms that have been successfully transformed with a vector and carry an appropriate antibiotic resistance gene (e.g. G418 or hygromycin) can be selected by appropriate antibiotic-comprising media or nutrient media. Marker proteins present on the cell surface can be used for selection by means of affinity chromatography.

As alternative preparation methods for sequences according to the invention, reference may be made to the chemical synthesis methods known per se, such as solid-phase synthesis or liquid-phase synthesis.

3.4 Recombinant Preparation of the Polypeptides:

The peptides used according to the invention can be prepared using recombinant techniques in a manner known per se, where a microorganism producing polypeptides is cultivated, if appropriate the expression of the polypeptides is induced and these are isolated from the culture. The polypeptides can also be produced on an industrial scale in this way if desired.

The recombinant microorganism can be cultured and fermented by known methods. Bacteria can be replicated, for example, in TB or LB medium and at a temperature of from 20 to 40° C. and a pH of from 6 to 9. Suitable culturing conditions are described in detail, for example, in T. Maniatis, E. F. Fritsch and J. Sambrook, Molecular Cloning: A Laboratory Manual, Cold Spring Harbor Laboratory, Cold Spring Harbor, N.Y. (1989).

If the polypeptides are not secreted into the culture medium, the cells are then disrupted and the product is obtained from the lysate by known protein isolation methods. The cells may alternatively be disrupted by high-frequency ultrasound, by high pressure, such as, for example, in a French pressure cell, by osmolysis, by the action of detergents, lytic enzymes or organic solvents, by homogenizers or by a combination of two or more of the methods listed.

The polypeptides can be purified by known chromatographic methods, such as molecular sieve chromatography (gel filtration), such as Q-Sepharose chromatography, ion exchange chromatography and hydrophobic chromatography, and by other customary methods, such as ultrafiltration, crystallization, salting out, dialysis and native gel electrophoresis. Suitable methods are described, for example, in Cooper, F. G., Biochemische Arbeitsmethoden, Verlag Walter de Gruyter, Berlin, New York or in Scopes, R., Protein Purification, Springer Verlag, New York, Heidelberg, Berlin.

It is particularly advantageous for isolation of the recombinant protein to use vector systems or oligonucleotides which extend the cDNA by specific nucleotide sequences and thus code for modified polypeptides or fusion proteins which serve, for example, for simpler purification. Suitable modifications of this type are, for example, so-called "tags" which act as anchors, such as, for example, the modification known as hexa-histidine anchor, or epitopes which can be recognized as antigens of antibodies (described, for example, in Harlow, E. and Lane, D., 1988, Antibodies: A Laboratory Manual. Cold Spring Harbor (N.Y.) Press). These anchors can be used to attach the proteins to a solid support, such as, for example, a polymer matrix which can, for example, be packed in a chromatography column, or can be used on a microtiter plate or another support.

These anchors can at the same time also be used for recognizing the proteins. Moreover, for recognizing the proteins, it is also possible to use customary markers, such as fluorescent dyes, enzyme markers which form a detectable reaction product following reaction with a substrate, or radioactive labels, alone or in combination with the anchors for derivatizing the proteins.

3.5 Embodiments of Compositions According to the Invention 3.5.1 General Fields of Application and Formulations The antimicrobial peptides according to the invention have a broad field of application in human cosmetics, in particular skincare and haircare, and also animal care, but can also be used pharmacologically.

The cosmetic compositions according to the invention are in particular skin cosmetic, nail cosmetic, hair cosmetic, dermatological, hygiene or pharmaceutical compositions. In particular, the antimicrobial peptides according to the invention are used for skin cosmetics, nail cosmetics and/or hair cosmetics or as oral care compositions. They permit the growth inhibition of undesired microorganisms which cause damage to hair and to skin, e.g. dandruff formation, to nails, e.g. increased nail brittleness, thickened nails, or which cause itching or burning.

According to a further embodiment, hair cosmetic or skin cosmetic preparations according to the invention serve in particular for the care or the protection of the skin or of the hair and are in the form of an emulsion, a dispersion, a suspension, an aqueous surfactant preparation, a milk, a lotion, a cream, a balsam, an ointment, a gel, granules, a powder, a stick preparation, such as, for example, a lipstick, a foam, an aerosol or a spray. Such formulations are highly suited to topical preparations. Suitable emulsions are oil-in-water emulsions and water-in-oil emulsions or microemulsions.

As a rule, the hair cosmetic or skin cosmetic preparation is used for application to the skin (topically) or to the hair. In this connection, "topical preparations" are to be understood as meaning those preparations which are suitable for applying the active ingredients to the skin in fine distribution. Of suitability for this purpose are, for example, aqueous and aqueous-alcoholic solutions, sprays, foams, foam aerosols, ointments, aqueous gels, emulsions of the O/W or W/O type, microemulsions or cosmetic stick preparations.

According to one embodiment of the cosmetic composition according to the invention, it comprises a carrier. Preferred carriers are water, a gas, a water-based liquid, an oil, a gel, an emulsion or microemulsion, a dispersion or a mixture thereof. Said carriers exhibit good skin compatibility. Aqueous gels, emulsions or microemulsions are particularly advantageous for topical preparations.

Besides customary additives and auxiliaries, the cosmetic compositions according to the invention can additionally comprise cosmetically and/or dermatologically active ingredients.

Examples of suitable further active ingredients are:

Suitable cosmetically and/or dermatologically active ingredients are, for example, coloring active ingredients, skin and hair pigmentation agents, tinting agents, tanning agents, bleaches, keratin-hardening substances, antimicrobial active ingredients, photofilter active ingredients, repellent active ingredients, hyperemic substances, keratolytically and keratoplastically effective substances, antidandruff active ingredients, antiphlogistics, keratinizing substances, antioxidative active ingredients and active ingredients that act as free-radical scavengers, substances which moisturize the skin or keep the skin moisturized, refatting active ingredients, antierythimatous or antiallergic active ingredients, branched fatty acids, such as 18-methyleicosanoic acid, and mixtures thereof.

Artificially skin-tanning active ingredients which are suitable for tanning the skin without natural or artificial irradiation with UV rays; these are, for example, dihydroxyacetone, alloxan and walnut shell extract. Suitable keratin-hardening substances are generally active ingredients which can also be used as antiperspirants, such as, for example, potassium aluminum sulfate, aluminum hydroxychloride, aluminum lactate, etc.

Antimicrobial active ingredients which are used in order to destroy microorganisms or to inhibit their growth. They thus serve both as preservatives and as deodorizing substance which reduces the formation or the intensity of body odor. These include, for example, customary preservatives known to the person skilled in the art, such as p-hydroxybenzoic acid esters, imidazolinylurea, formaldehyde, sorbic acid, benzoic acid, salicylic acid etc. Such deodorizing substances are, for example, zinc ricinoleate, triclosan, undecylenic acid alkylolamides, triethyl citrate, chlorhexidin etc.

Suitable auxiliaries and additives for the production of hair cosmetic, nail cosmetic or skin cosmetic preparations are familiar to the person skilled in the art and can be found in handbooks on cosmetics, for example Schrader, Grundlagen und Rezepturen der Kosmetika [Fundamentals and formulations of cosmetics], Hüthig Verlag, Heidelberg, 1989, ISBN 3-7785-1491-1. The auxiliaries and additives are preferably cosmetically and/or pharmaceutically acceptable auxiliaries. Of pharmaceutical acceptability are the auxiliaries known for use in the field of pharmacy, food technology and related fields, in particular those listed in the relevant pharmacopeia (e.g. DAB, Ph. Eur., BP, NF), and other auxiliaries whose properties do not preclude a physiological application.

Suitable auxiliaries may be: lubricants, wetting agents, emulsifying and suspending agents, preservatives, antioxidants, antiirritatives, chelating agents, emulsion stabilizers, film formers, gel formers, odor masking agents, hydrocolloids, solvents, solubility promoters, neutralizers, permeation accelerators, pigments, quaternary ammonium compounds, refatting and superfatting agents, ointment, cream or oil base substances, silicone derivatives, stabilizers, sterilants, propellants, drying agents, opacifiers, thickeners, waxes, softeners, white oil. An embodiment in this regard is based on technical knowledge, as presented, for example, in Fiedler, H. P. Lexikon der Hilfsstoffe für Pharmazie, Kosmetik and angrenzende Gebiete [Lexicon of auxiliaries for pharmacy, cosmetics and related fields], $4^{th}$ edition, Aulendorf: ECV-Editio-Kantor-Verlag, 1996.

Further suitable additives are selected from perfume oils, hair polymers, hair and skin conditioners, graft polymers, water-soluble or dispersible silicone-containing polymers, photoprotective agents, bleaches, care agents, colorants, tinting agents, tanning agents, dyes, consistency regulators, humectants, refatting agents, collagen, protein hydrolyzates, lipids, antioxidants, antifoams, antistatics, emollients, softeners, peroxide decomposers.

Specific examples of suitable auxiliaries and additives are (these may also be covalently or noncovalently bonded to the peptides according to the invention):

(1) Antioxidants selected from amino acids (e.g. glycine, histidine, tyrosine, tryptophan) and derivatives thereof, imidazoles (e.g. urocanic acid) and derivatives thereof, peptides such as D,L-carnosine, D-carnosine, L-carnosine and derivatives thereof (e.g. anserine), carotinoids, carotenes (e.g. β-carotene, lycopene) and derivatives thereof, chlorogenic acid and derivatives thereof, lipoic acid and derivatives thereof (e.g. dihydrolipoic acid), aurothioglucose, propylthiouracil and other thiols (e.g. thiorodoxin, glutathione, cysteine, cystine, cystamine and the glycosyl, N-acetyl, methyl, ethyl, propyl, amyl, butyl, and lauryl, palmitoyl, oleyl, γ-linoleyl, cholesteryl and glyceryl esters thereof) and salts thereof, dilauryl thiodipropionate, distearyl thiodipropionate, thiodipropionic acid and derivatives thereof (esters, ethers, peptides, lipids, nucleotides, nucleosides and salts), and sulfoximine compounds (e.g. buthionine sulfoximines, homocysteine sulfoximines, buthionine sulfones, penta-, hexa-, heptathionine sulfoximine), in particular in very low tolerated doses (e.g. pmol to µmol/kg range), also (metal) chelating agents (e.g. α-hydroxy fatty acids, palmitic acid, phytic acid, lactoferrin), α-hydroxy acids (e.g. citric acid, lactic acid, malic acid), humic acid, bile acid, bile extracts, bilirubin, biliverdin, EDTA and derivatives thereof, unsaturated fatty acids and derivatives thereof (e.g. γ-linolenic acid, linoleic acid, oleic acid), folic acid and derivatives thereof, ubiquinone and ubiquinol and derivatives thereof, vitamin C and derivatives thereof (e.g. sodium ascorbate, ascorbyl palmitate, Mg ascorbyl phosphate, ascorbyl acetate), tocopherol and derivatives (e.g. vitamin E acetate, tocotrienol), vitamin A and derivatives (vitamin A palmitate), and coniferyl benzoate of benzoin resin, rutinic acid and derivatives thereof, α-glycosylrutin, ferulic acid, furfurylideneglucitol, carnosine, butylhydroxytoluene, butylhydroxyanisole, nordihydroguaiacic acid, nordihydroguaiaretic acid, trihydroxybutyrophenone, uric acid and derivatives thereof, mannose and derivatives thereof, zinc and derivatives thereof (e.g. ZnO, $ZnSO_4$), selenium and derivatives thereof (e.g. selenomethionine), stilbenes and derivatives thereof (e.g. stilbene oxide, trans-stilbene oxide).

(2) Peroxide decomposers, i.e. compounds which are able to decompose peroxides, particularly preferably lipid peroxides. These are to be understood as including organic substances, such as, for example, pyridine-2-thiol-3-carboxylic acid, 2-methoxy-pyrimidinolcarboxylic acids, 2-methoxypyridinecarboxylic acids, 2-dimethylaminopyrimidinolcarboxylic acids, 2-dimethylaminopyridinecarboxylic acids.

(3) Thickeners, such as crosslinked polyacrylic acids and derivatives thereof, polysaccharides and derivatives thereof, such as xanthan gum, agar agar, alginates or tyloses, cellulose derivatives, e.g. carboxymethylcellulose or hydroxycarboxymethylcellulose, fatty alcohols, monoglycerides and fatty acids, polyvinyl alcohol and polyvinylpyrrolidone. Preference is given to using nonionic thickeners.

(4) Preservatives which are listed below with their E numbers

| | | |
|---|---|---|
| E 200 | Sorbic acid | |
| E 201 | Sodium sorbate | |
| E 202 | Potassium sorbate | |
| E 203 | Calcium sorbate | |
| E 210 | Benzoic acid | |
| E 211 | Sodium benzoate | |
| E 212 | Potassium benzoate | |
| E 213 | Calcium benzoate | |
| E 214 | Ethyl p-hydroxybenzoate | |
| E 215 | Ethyl p-hydroxybenzoate Na salt | |
| E 216 | n-Propyl p-hydroxybenzoate | |
| E 217 | n-Propyl p-hydroxybenzoate Na salt | |
| E 218 | Methyl p-hydroxybenzoate | |
| E 219 | Methyl p-hydroxybenzoate Na salt | |
| E 220 | Sulfur dioxide | |
| E 221 | Sodium sulfite | |
| E 222 | Sodium hydrogen sulfite | |
| E 223 | Sodium disulfite | |
| E 224 | Potassium disulfite | |
| E 226 | Calcium sulfite | |
| E 227 | Calcium hydrogensulfite | |
| E 228 | Potassium hydrogensulfite | |
| E 230 | Biphenyl (diphenyl) | |
| E 231 | Orthophenylphenol | |
| E 232 | Sodium orthophenylphenoxide | |
| E 233 | Thiabendazole | |
| E 235 | Natamycin | |
| E 236 | Formic acid | |
| E 237 | Sodium formate | |
| E 238 | Calcium formate | |
| E 239 | Hexamethylenetetramine | |
| E 249 | Potassium nitrite | |
| E 250 | Sodium nitrite | |
| E 251 | Sodium nitrate | |
| E 252 | Potassium nitrate | |
| E 280 | Propionic acid | |
| E 281 | Sodium propionate | |
| E 282 | Calcium propionate | |
| E 283 | Potassium propionate | |
| E 290 | Carbon dioxide | |

Also suitable according to the invention are preservatives or preservative auxiliaries customary in cosmetics, such as dibromodicyanobutane (2-bromo-2-bromomethyl-glutarodinitrile), 3-iodo-2-propynyl butylcarbamate, 2-bromo-2-nitropropane-1,3-diol, imidazolidinylurea, 5-chloro-2-methyl-4-isothiazolin-3-one, 2-chloroacetamide, benzalkonium chloride, benzyl alcohol, formaldehyde donors.

Also suitable as preservatives are phenyl hydroxyalkyl ethers, in particular the compound known under the name phenoxyethanol, on account of their bactericidal and fungicidal effects on a number of microorganisms.

Other antimicrobial agents are also likewise suitable for being incorporated into the preparations according to the invention. Advantageous substances are, for example, 2,4,4'-trichloro-2'-hydroxydiphenyl ether (irgasan), 1,6-di(4-chlorophenylbiguanido)-hexane (chlorhexidine), 3,4,4'-trichlorocarbanilide, quaternary ammonium compounds, oil of cloves, mint oil, thyme oil, triethyl citrate, farnesol (3,7,11-trimethyl-2,6,10-dodecatrien-14), and also the active ingredients and active ingredient combinations described in the patent laid-open specifications DE-37 40 186, DE-39 38 140, DE-42 04 321, DE-42 29 707, DE-43 09 372, DE-44 11 664, DE-195 41 967, DE-195 43 695, DE-195 43 696, DE-195 47 160, DE-196 02 108, DE-196 02 110, DE-196 02 111, DE-196 31 003, DE-196 31 004 and DE-196 34 019 and the patent specifications DE-42 29 737, DE-42 37 081, DE-43 24 219, DE-44 29 467, DE-44 23 410 and DE-195 16 705. Sodium hydrogencarbonate is also to be used advantageously. Antimicrobial polypeptides can likewise also be used.

(5) Photofilter active ingredients which absorbed UV rays in the UV-B and/or UV-A region. Suitable UV filters are, for example, 2,4,6-triaryl-1,3,5-triazines in which the aryl groups can in each case carry at least one substituent which is preferably selected from hydroxy, alkoxy, specifically methoxy, alkoxycarbonyl, specifically methoxycarbonyl and ethoxycarbonyl, and mixtures thereof. Also suitable are p-aminobenzoic acid esters, cinnamic acid esters, benzophenonones, camphor derivatives, and pigments that block UV rays, such as titanium dioxide, talc and zinc oxide.

Suitable UV filter substances are any desired UV-A and UV-B filter substances. Examples are:

| No. | Substance | CAS No. (=acid) |
|---|---|---|
| 1 | 4-Aminobenzoic acid | 150-13-0 |
| 2 | 3-(4'-Trimethylammonium)benzylidenebornan-2-one methylsulfate | 52793-97-2 |
| 3 | 3,3,5-Trimethylcyclohexyl salicylate (homosalate) | 118-56-9 |
| 4 | 2-Hydroxy-4-methoxybenzophenone (oxybenzone) | 131-57-7 |
| 5 | 2-Phenylbenzimidazole-5-sulfonic acid and its potassium, sodium and triethanolamine salts | 27503-81-7 |
| 6 | 3,3'-(1,4-Phenylenedimethine)bis(7,7-dimethyl-2-oxobicyclo[2.2.1]heptane-1-methanesulfonic acid) and its salts | 90457-82-2 |
| 7 | Polyethoxyethyl 4-bis(polyethoxy)aminobenzoate | 113010-52-9 |
| 8 | 2-Ethylhexyl 4-dimethylaminobenzoate | 21245-02-3 |
| 9 | 2-Ethylhexyl salicylate | 118-60-5 |
| 10 | 2-Isoamyl 4-methoxycinnamate | 71617-10-2 |
| 11 | 2-Ethylhexyl 4-methoxycinnamate | 5466-77-3 |
| 12 | 2-Hydroxy-4-methoxybenzophenone-5-sulfonic acid (sulisobenzone) and the sodium salt | 4065-45-6 |
| 13 | 3-(4'-Sulfobenzylidene)bornan-2-one and salts | 58030-58-6 |
| 14 | 3-Benzylidenebornan-2-one | 16087-24-8 |
| 15 | 1-(4'-Isopropylphenyl)-3-phenylpropane-1,3-dione | 63260-25-9 |
| 16 | 4-Isopropylbenzylsalicylate | 94134-93-7 |
| 17 | 3-Imidazol-4-ylacrylic acid and its ethyl ester | 104-98-3 |
| 18 | Ethyl 2-cyano-3,3-diphenylacrylate | 5232-99-5 |
| 19 | 2'-Ethylhexyl 2-cyano-3,3-diphenylacrylate | 6197-30-4 |
| 20 | Menthyl o-aminobenzoate or: 5-methyl-2-(1-methylethyl)-2-aminobenzoate | 134-09-8 |
| 21 | Glyceryl p-aminobenzoate or: 1-glyceryl 4-aminobenzoate | 136-44-7 |
| 22 | 2,2'-Dihydroxy-4-methoxybenzophenone (dioxybenzone) | 131-53-3 |
| 23 | 2-Hydroxy-4-methoxy-4-methylbenzophenone (mexenone) | 1641-17-4 |
| 24 | Triethanolaminee salicylate | 2174-16-5 |
| 25 | Dimethoxyphenylglyoxalic acid or: sodium 3,4-dimethoxyphenylglyoxalate | 4732-70-1 |
| 26 | 3-(4'Sulfobenzylidene)bornan-2-one and its salts | 56039-58-8 |
| 27 | 4-tert-Butyl-4'-methoxy-dibenzoylmethane | 70356-09-1 |
| 28 | 2,2',4,4'-Tetrahydroxybenzophenone | 131-55-5 |
| 29 | 2,2'-Methylenebis[6-(2H-benzotriazol-2-yl)-4-(1,1,3,3,-tetramethylbutyl)phenol] | 103597-45-1 |
| 30 | 2,2'-(1,4-Phenylene)bis-1H-benzimidazole-4,6-disulfonic acid, Na salt | 180898-37-7 |
| 31 | 2,4-bis[4-(2-Ethylhexyloxy)-2-hydroxy]phenyl-6-(4-methoxyphenyl)(1,3,5)-triazine | 187393-00-6 |
| 32 | 3-(4-Methylbenzylidene)camphor | 36861-47-9 |
| 33 | Polyethoxyethyl 4-bis(polyethoxy)paraaminobenzoate | 113010-52-9 |
| 34 | 2,4-Dihydroxybenzophenone | 131-56-6 |
| 35 | 2,2'-Dihydroxy-4,4'-dimethoxybenzophenone-5,5'-disodium sulfonate | 3121-60-6 |
| 36 | 2-[4-(Diethylamino)-2-hydroxybenzoyl]hexyl benzoate | 302776-68-7 |
| 37 | 2-(2H-Benzotriazol-2-yl)-4-methyl-6-[2-methyl-3-[1,3,3,3-tetramethyl-1-[(trimethylsilyl)oxy]disiloxanyl]propyl]phenol | 155633-54-8 |
| 38 | 1,1-[(2,2'-Dimethylpropoxy)carbonyl]-4,4-diphenyl-1,3-butadiene | 363602-15-7 |

Furthermore, the cosmetic and dermatological preparations according to the invention can advantageously comprise inorganic pigments which block UV rays and are based on metal oxides and/or other metal compounds that are insoluble or sparingly soluble in water selected from the group of the oxides of zinc (ZnO), titanium ($TiO_2$), iron (e.g. $Fe_2O_3$), zirconium ($ZrO_2$), silicon ($SiO_2$), manganese (e.g. MnO), aluminum ($Al_2O_3$), cerium (e.g. $Ce_2O_3$), mixed oxides of the corresponding metals and mixtures of such oxides.

The inorganic pigments here may be present in coated form, i.e. be surface-treated. This surface treatment can, for example, consist in providing the pigments with a thin hydrophobic layer by the method known per se, as described in DE-A-33 14 742.

(6) Repellent active ingredients, i.e. compounds which are able to keep away or drive away certain animals, in particular insects, from people. These include, for example, 2-ethyl-1,3-hexanediol, N,N-diethyl-m-toluamide etc. Suitable hyperemic substances, which stimulate blood flow through the skin, are, for example, essential oils, such as dwarf-pine needle extract, lavender extract, rosemary extract, juniper berry extract, horse chestnut extract, birch leaf extract, hay flower extract, ethyl acetate, camphor, menthol, peppermint oil, rosemary extract, eucalyptus oil etc. Suitable keratolytic and keratoplastic substances are, for example, salicylic acid, calcium thioglycolate, thioglycolic acid and its salts, sulfur etc. Suitable antidandruff active ingredients are, for example, sulfur, sulfur polyethylene glycol sorbitan monooleate, sulfur ricinol polyethoxylate, zinc pyrithione, aluminum pyrithione etc. Suitable antiphlogistics, which counteract skin irritations, are, for example, allantoin, bisabolol, dragosantol, camomile extract, panthenol etc.

(7) Cosmetically or pharmaceutically acceptable polymers, such as cationic, amphoteric and neutral polymers.

Suitable polymers are, for example, cationic polymers with the INCI name Polyquaternium, e.g. copolymers of vinylpyrrolidone/N-vinylimidazolium salts (Luviquat FC, Luviquat HM, Luviquat MS, Luviquat, Care), copolymers of N-vinylpyrrolidone/dimethylaminoethyl methacrylate, quaternized with diethyl sulfate (Luviquat PQ 11), copolymers of N-vinylcaprolactam/N-vinylpyrrolidone/N-vinylimidazolium salts (Luviquat E Hold), cationic cellulose derivatives (Polyquaternium-4 and -10), acrylamido copolymers (Polyquaternium-7) and chitosan.

Suitable cationic (quaternized) polymers are also Merquat (polymer based on dimethyldiallylammonium chloride), Gafquat (quaternary polymers which are formed by the reaction of polyvinylpyrrolidone with quaternary ammonium compounds), polymer JR (hydroxyethylcellulose with cationic groups) and cationic polymers based on plants, e.g. guar polymers, such as the Jaguar grades from Rhodia.

Further suitable polymers are also neutral polymers, such as polyvinylpyrrolidones, copolymers of N-vinylpyrrolidone and vinyl acetate and/or vinyl propionate, polysiloxanes, polyvinylcaprolactam and other copolymers with N-vinylpyrrolidone, polyethyleneimines and salts thereof, polyvinylamines and salts thereof, cellulose derivatives, polyaspartic acid salts and derivatives thereof. These include, for example, Luviflex® Swing (partially saponified copolymer of polyvinyl acetate and polyethylene glycol, BASF).

Suitable polymers are also nonionic, water-soluble or water-dispersible polymers or oligomers, such as polyvinylcaprolactam, e.g. Luviskol® Plus (BASF), or polyvinylpyrrolidone and copolymers thereof, in particular with vinyl esters, such as vinyl acetate, e.g. Luviskol® VA 37 (BASF), polyamides, e.g. based on itaconic acid and aliphatic diamines, as are described, for example, in DE-A-43 33 238.

Suitable polymers are also amphoteric or zwitterionic polymers, such as the octylacrylamide/methyl methacrylate/tert-butylaminoethyl methacrylate-hydroxypropyl methacrylate copolymers obtainable under the names Amphomer (National Starch), and also zwitterionic polymers as are disclosed, for example, in the German patent applications DE 39 29 973, DE 21 50 557, DE 28 17 369 and DE 37 08 451. Acrylamidopropyltrimethylammonium chloride/acrylic acid or methacrylic acid copolymers and the alkali metal and ammonium salts thereof are preferred zwitterionic polymers. Furthermore, suitable zwitterionic polymers are methacryloylethyl-betaine/methacrylate copolymers, which are commercially available under the name Amersette (AMERCHOL), and copolymers of hydroxyethyl methacrylate, methyl methacrylate, N,N-dimethylaminoethyl methacrylate and acrylic acid (Jordapon (D)).

Suitable polymers are also nonionic, siloxane-containing, water-soluble or dispersible polymers, e.g. polyether siloxanes, such as Tegopren (Goldschmidt) and Besi (Wacker).

3.5.2 Particular Compositions According to the Invention

According to a preferred embodiment, the compositions according to the invention are a skin or hair cleaning composition.

Preferred skin or hair cleaning compositions are soaps of liquid to gel-like consistency, such as transparent soaps, luxury soaps, deodorant soaps, cream soaps, baby soaps, skin protection soaps, abrasive soaps and syndets, pasty soaps, soft soaps and washing pastes, peeling soaps, wet wipes, liquid washing, shower and bathing preparations, such as washing lotions, shower baths and shower gels, foam baths, oil baths and scrub preparations, shaving foams, shaving lotions and shaving creams.

According to a further preferred embodiment, the compositions according to the invention are a shower gel, a shampoo formulation or a bathing preparation. Such formulations comprise at least one antimicrobial peptide and usually anionic surfactants as base surfactants and amphoteric and/or nonionic surfactants as cosurfactants. Further suitable active ingredients and/or auxiliaries are generally selected from lipids, perfume oils, dyes, organic acids, preservatives and antioxidants, and also thickeners/gel formers, skin conditioners and humectants.

i) Specific Embodiments for Compositions for Applying to the Skin:

Suitable skin cosmetic compositions are, for example, face tonics, face masks, deodorants and other cosmetic lotions. Compositions for use in decorative cosmetics comprise, for example, concealing sticks, stage make-up, mascara and eye shadows, lipsticks, kohl pencils, eyeliners, blushers, powders and eyebrow pencils.

Furthermore, the dermatological agents according to the invention can be used in nose-strips for pore cleansing, in antiacne compositions, repellents, shaving compositions, aftershave and preshave care compositions, aftersun care compositions, hair removal compositions, hair colorants, intimate care compositions, foot care compositions and in babycare.

The skincare compositions according to the invention are in particular W/O or O/W skin creams, day and night creams, eye creams, face creams, antiwrinkle creams, sunscreen creams, moisturizing creams, bleaching creams, self-tanning creams, vitamin creams, skin lotions, care lotions and moisturizing lotions.

Skin cosmetic and dermatological compositions preferably comprise at least one peptide in an amount of from about 0.0001 to 50% by weight, preferably 0.001 to 10% by weight, very particularly preferably 0.0057 to 0.1% by weight, based on the total weight of the composition.

Depending on the field of application, the skin cosmetic compositions according to the invention can be applied in a form suitable for skincare, such as, for example, as cream, foam, gel, stick, mousse, milk, spray (pump spray or propellant-containing spray).

Besides the peptides according to the invention and suitable carriers, the skin cosmetic preparations can also comprise further active ingredients and auxiliaries customary in skin cosmetics, as described previously. These include, preferably, emulsifiers, preservatives, perfume oils, cosmetic active ingredients, such as phytantriol, vitamin A, E and C, retinol, bisabolol, panthenol, photoprotective agents, bleaches, colorants, tinting agents, tanning agents, collagen, enzymes, protein hydrolyzates, stabilizers, pH regulators, dyes, salts, thickeners, gel formers, consistency regulators, silicones, humectants, refatting agents and further customary additives.

Preferred oil and fat components of the skin cosmetic and dermatological compositions are the abovementioned mineral and synthetic oils, such as, for example, paraffins, silicone oils and aliphatic hydrocarbons with more than 8 carbon atoms, animal and vegetable oils, such as, for example, sunflower oil, coconut oil, avocado oil, olive oil, lanolin, or waxes, fatty acids, fatty acid esters, such as, for example, triglycerides of $C_6$-$C_{30}$-fatty acids, wax esters, such as, for example, jojoba oil, fatty alcohols, vaseline, hydrogenated lanolin and acetylated lanolin, and mixtures thereof.

To establish certain properties, such as, for example, improving the feel to the touch, the spreading behavior, the water resistance and/or the binding of active ingredients and auxiliaries, such as pigments, the skin cosmetic and dermatological preparations can additionally also comprise conditioning substances based on silicone compounds. Suitable silicone compounds are, for example, polyalkylsiloxanes, polyarylsiloxanes, polyarylalkylsiloxanes, polyether siloxanes or silicone resins.

The cosmetic or dermatological preparations are produced in accordance with customary methods known to the person skilled in the art.

To produce the dermatological compositions according to the invention, the active ingredients can be mixed or diluted with a suitable auxiliary (excipient). Excipients can be solid, semisolid or liquid materials which can serve as vehicles, carriers or medium for the active ingredient. The admixing of further auxiliaries takes place if desired in the manner known to the person skilled in the art. Furthermore, the polymers and dispersions are suitable as auxiliaries in pharmacy, preferably as or in (a) coating(s) or (a) binder(s) for solid drug forms. They can also be used in creams and as tablet coatings and tablet binders.

Preferably, the cosmetic and dermatological compositions are present in the form of emulsions, in particular as water-in-oil (W/O) or oil-in-water (O/W) emulsions. However, it is also possible to choose other types of formulation, for example gels, oils, oleogels, multiple emulsions, for example in the form of W/O/W or O/W/O emulsions, anhydrous ointments or ointment bases etc. Emulsifier-free formulations such as hydrodispersions, hydrogels or a Pickering emulsion are also advantageous embodiments.

The preparation of emulsions takes place by known methods. Besides at least one peptide according to the invention, the emulsions generally comprise customary constituents, such as fatty alcohols, fatty acid esters and in particular fatty acid triglycerides, fatty acids, lanolin and derivatives thereof, natural or synthetic oils or waxes and emulsifiers in the presence of water. The selection of additives specific to the type of emulsion and the preparation of suitable emulsions is described, for example, in Schrader, Grundlagen and Rezepturen der Kosmetika [Fundamentals and formulations of cosmetics], Hüthig Buch Verlag, Heidelberg, 2nd edition, 1989, third part, to which reference is hereby expressly made.

A suitable emulsion as W/O emulsion, e.g. for a skin cream etc., generally comprises an aqueous phase which is emulsified in an oil or fatty phase by means of a suitable emulsifier system. A polyelectrolyte complex can be used for producing the aqueous phase.

Preferred fatty components which may be present in the fatty phase of the emulsions are: hydrocarbon oils, such as paraffin oil, Purcellin oil, perhydrosqualene and solutions of microcrystalline waxes in these oils; animal or vegetable oils, such as sweet almond oil, avocado oil, calophylum oil, lanolin and derivatives thereof, castor oil, sesame oil, olive oil, jojoba oil, karite oil, hoplostethus oil, mineral oils whose distillation start under atmospheric pressure is at about 250° C. and whose distillation end point is at 410° C., such as, for example, vaselin oil, esters of saturated or unsaturated fatty acids, such as alkyl myristates, e.g. isopropyl, butyl or cetyl myristate, hexadecyl stearate, ethyl or isopropyl palmitate, octanoic acid or decanoic acid triglycerides and cetyl ricinoleate.

The fatty phase can also comprise silicone oils that are soluble in other oils, such as dimethylpolysiloxane, methylphenylpolysiloxane and the silicone glycol copolymer, fatty acids and fatty alcohols.

Besides the peptides according to the invention, it is also possible to use waxes, such as, for example, carnauba wax, candelilla wax, beeswax, microcrystalline wax, ozokerite wax and Ca, Mg and Al oleates, myristates, linoleates and stearates.

Furthermore, an emulsion according to the invention can be in the form of an O/W emulsion. Such a type of emulsion usually comprises an oil phase, emulsifiers which stabilize the oil phase in the water phase, and an aqueous phase, which is usually present in thickened form. Suitable emulsifiers are preferably O/W emulsifiers, such as polyglycerol esters, sorbitan esters or partially esterified glycerides.

According to a further preferred embodiment, the compositions according to the invention are a shower gel, a shampoo formulation or a bathing preparation.

Such formulations comprise at least one peptide according to the invention and usually anionic surfactants as base surfactants and amphoteric and/or nonionic surfactants as cosurfactants. Further suitable active ingredients and/or auxiliaries are generally selected from lipids, perfume oils, dyes, organic acids, preservatives and antioxidants, and thickeners/gel formers, skin conditioners and moisturizers.

These formulations comprise preferably 2 to 50% by weight, preferably 5 to 40% by weight, particularly preferably 8 to 30% by weight, of surfactants, based on the total weight of the formulation.

All anionic, neutral, amphoteric or cationic surfactants customarily used in body cleaning compositions can be used in the washing, showering and bathing preparations.

Suitable anionic surfactants are, for example, alkyl sulfates, alkyl ether sulfates, alkylsulfonates, alkylarylsulfonates, alkyl succinates, alkyl sulfosuccinates, N-alkoyl sarcosinates, acyl taurates, acyl isothionates, alkyl phosphates, alkyl ether phosphates, alkyl ether carboxylates, alpha-olefinsulfonates, in particular the alkali metal and alkaline earth metal salts, e.g. sodium, potassium, magnesium, calcium, and also ammonium and triethanolamine salts. The alkyl ether sulfates, alkyl ether phosphates and alkyl ether carboxylates can have between 1 and 10 ethylene oxide or propylene oxide units, preferably 1 to 3 ethylene oxide units, in the molecule.

These include, for example, sodium lauryl sulfate, ammonium lauryl sulfate, sodium lauryl ether sulfate, ammonium lauryl ether sulfate, sodium lauryl sarcosinate, sodium oleyl succinate, ammonium lauryl sulfosuccinate, sodium dodecylbenzenesulfonate, triethanolamine dodecylbenzenesulfonate.

Suitable amphoteric surfactants are, for example, alkylbetaines, alkylamidopropylbetaines, alkylsulfobetaines, alkyl glycinates, alkyl carboxyglycinates, alkyl amphoacetates or -propionates, alkyl amphodiacetates or -dipropionates.

For example, cocodimethylsulfopropylbetaine, laurylbetaine, cocamidopropylbetaine or sodium cocamphopropionate can be used.

Suitable nonionic surfactants are, for example, the reaction products of aliphatic alcohols or alkylphenols having 6 to 20 carbon atoms in the alkyl chain, which may be linear or branched, with ethylene oxide and/or propylene oxide. The amount of alkylene oxide is about 6 to 60 moles per mole of alcohol. Also suitable are alkylamine oxides, mono- or dialkylalkanolamines, fatty acid esters of polyethylene glycols, ethoxylated fatty acid amides, alkyl polyglycosides or sorbitan ether esters.

Furthermore, the washing, showering and bathing preparations can comprise customary cationic surfactants, such as, for example, quaternary ammonium compounds, for example cetyltrimethylammonium chloride.

Furthermore, the shower gel/shampoo formulations can comprise thickeners, such as, for example, sodium chloride PEG-55, propylene glycol oleate, PEG-120 methylglucose dioleate and others, and also preservatives, further active ingredients and auxiliaries and water.

ii) Specific Embodiments for Hair Treatment Compositions

According to a further preferred embodiment, the compositions according to the invention are a hair treatment composition.

Hair treatment compositions according to the invention comprise preferably at least one peptide according to the invention in an amount in the range from about 0.0001 to 50% by weight, preferably 0.001 to 10% by weight, particularly preferably 0.0057 to 0.1% by weight, based on the total weight of the composition.

Preferably, the hair treatment compositions according to the invention are in the form of a setting foam, hair mousse, hair gel, shampoo, hairspray, hair foam, end fluid, neutralizer for permanent waves, hair colorant and bleach or "hot-oil treatment". Depending on the field of use, the hair cosmetic preparations can be applied as (aerosol) spray, (aerosol) foam, gel, gel spray, cream, lotion or wax. Hairsprays here comprise both aerosol sprays and also pump sprays without propellant gas. Hair foams comprise both aerosol foams and also pump foams without propellant gas. Hairsprays and hair foams comprise preferably predominantly or exclusively water-soluble or water-dispersible components. If the compounds used in the hairsprays and hair foams according to the invention are water-dispersible, they can be applied in the form of aqueous microdispersions with particle diameters of usually 1 to 350 nm, preferably 1 to 250 nm. The solids contents of these preparations are usually in a range from about 0.5 to 20% by weight. These microdispersions generally require no emulsifiers or surfactants for their stabilization.

The hair cosmetic formulations according to the invention comprise, in a preferred embodiment, a) 0.0001 to 50% by weight of at least one peptide according to the invention, b) 20 to 99.95% by weight of water and/or alcohol, c) 0 to 50% by weight of at least one propellant gas, d) 0 to 5% by weight of at least one emulsifier, e) 0 to 3% by weight of at least one thickener, and also up to 25% by weight of further constituents.

Alcohol is to be understood as meaning all alcohols customary in cosmetics, for example ethanol, isopropanol, n-propanol.

Also included here are all styling and conditioner polymers known in cosmetics which can be used in combination with the peptides according to the invention if quite specific properties are to be set.

Suitable conventional hair cosmetics polymers are, for example, the aforementioned cationic, anionic, neutral, nonionic and amphoteric polymers, to which reference is hereby made.

To establish certain properties, the preparations can additionally also comprise conditioning substances based on silicone compounds. Suitable silicone compounds are, for example, polyalkylsiloxanes, polyarylsiloxanes, polyarylalkylsiloxanes, polyether siloxanes, silicone resins or dimethicone copolyols (CTFA) and aminofunctional silicone compounds, such as amodimethicones (CTFA).

The polymers according to the invention are suitable in particular as setting agents in hairstyling preparations, in particular hairsprays (aerosol sprays and pump sprays without propellant gas) and hair foams (aerosol foams and pump foams without propellant gas).

In a preferred embodiment, spray preparations comprise a) 0.0001 to 50% by weight of at least one polypeptide according to the invention, b) 20 to 99.9% by weight of water and/or alcohol, c) 0 to 70% by weight of at least one propellant, d) 0 to 20% by weight of further constituents.

Propellants are the propellants customarily used for hairsprays or aerosol foams. Preference is given to mixtures of propane/butane, pentane, dimethyl ether, 1,1-difluoroethane (HFC-152 a), carbon dioxide, nitrogen or compressed air.

A formulation for aerosol hair foams preferred according to the invention comprises a) 0.0001 to 50% by weight of at least one peptide according to the invention, b) 55 to 99.8% by weight of water and/or alcohol, c) 5 to 20% by weight of a propellant, d) 0.1 to 5% by weight of an emulsifier, e) 0 to 10% by weight of further constituents.

Emulsifiers that can be used are all emulsifiers customarily used in hair foams. Suitable emulsifiers may be nonionic, cationic or anionic or amphoteric.

Examples of nonionic emulsifiers (INCI nomenclature) are laureths, e.g. laureth-4; ceteths, e.g. ceteth-1, polyethylene glycol cetyl ether, ceteareths, e.g. ceteareth-25, polyglycol fatty acid glycerides, hydroxylated lecithin, lactyl esters of fatty acids, alkyl polyglycosides.

Examples of cationic emulsifiers are cetyldimethyl-2-hydroxyethylammonium dihydrogenphosphate, cetyltrimonium chloride, cetyltrimmonium bromide, cocotrimonium methyl sulfate, quaternium-1 to x (INCI).

Anionic emulsifiers can be selected, for example, from the group of alkyl sulfates, alkyl ether sulfates, alkylsulfonates, alkylarylsulfonates, alkyl succinates, alkyl sulfosuccinates, N-alkoyl sarcosinates, acyl taurates, acyl isethionates, alkyl phosphates, alkyl ether phosphates, alkyl ether carboxylates, alpha-olefinsulfonates, in particular the alkali metal and alkaline earth metal salts, e.g. sodium, potassium, magnesium, calcium, and also ammonium and triethanolamine salts. The alkyl ether sulfates, alkyl ether phosphates and alkyl ether carboxylates can have between 1 and 10 ethylene oxide or propylene oxide units, preferably 1 to 3 ethylene oxide units, in the molecule.

A preparation suitable according to the invention for styling gels can, for example, have the following composition: a) 0.0001 to 50% by weight of at least one peptide according to the invention, b) 80 to 99.85% by weight of water and/or alcohol, c) 0 to 3% by weight, preferably 0.05 to 2% by weight, of a gel former, d) 0 to 20% by weight of further constituents.

The use of gel formers may be advantageous in order to set specific rheological or other application properties of the gels. Gel formers that can be used are all gel formers customary in cosmetics. These include lightly crosslinked polyacrylic acid, for example carbomer (INCI), cellulose derivatives, e.g. hydroxypropylcellulose, hydroxyethylcellulose, cationically modified celluloses, polysaccharides, e.g. xanthan gum, caprylic/capric triglyceride, sodium acrylate copolymers, polyquaternium-32 (and) paraffinum liquidum (INCI), sodium acrylate copolymers (and) paraffinum liquidum (and) PPG-1 trideceth-6, acrylamidopropyltrimonium chloride/acrylamide copolymers, steareth-10 allyl ether, acrylate copolymers, polyquaternium-37 (and) paraffinum liquidum (and) PPG-1 trideceth-6, polyquaternium 37 (and) propylene glycol dicaprate dicaprylate (and) PPG-1 trideceth-6, polyquaternium-7, polyquaternium-44.

A preparation comprising the peptides according to the invention can preferably be used in shampoo formulations as antidandruff agent. Preferred shampoo formulations comprise a) 0.0001 to 50% by weight of at least one peptide according to the invention, b) 25 to 94.95% by weight of water, c) 5 to 50% by weight of surfactants, c) 0 to 5% by weight of a further conditioner, d) 0 to 10% by weight of further cosmetic constituents.

All anionic, neutral, amphoteric or cationic surfactants customarily used in shampoos can be used in the shampoo formulations.

Suitable anionic surfactants are, for example, alkyl sulfates, alkyl ether sulfates, alkylsulfonates, alkylarylsulfonates, alkyl succinates, alkyl sulfosuccinates, N-alkoyl sarcosinates, acyl taurates, acyl isothionates, alkyl phosphates, alkyl ether phosphates, alkyl ether carboxylates, alpha-olefinsulfonates, in particular the alkali metal and alkaline earth metal salts, e.g. sodium, potassium, magnesium, calcium, and ammonium and triethanolamine salts. The alkyl ether sulfates, alkyl ether phosphates and alkyl ether carboxylates can have between 1 and 10 ethylene oxide or propylene oxide units, preferably 1 to 3 ethylene oxide units, in the molecule.

Of suitability are, for example, sodium lauryl sulfate, ammonium lauryl sulfate, sodium lauryl ether sulfate, ammonium lauryl ether sulfate, sodium lauroyl sarcosinate, sodium oleyl succinate, ammonium lauryl sulfosuccinate, sodium dodecylbenzenesulfonate, triethanolamine dodecylbenzenesulfonate.

Suitable amphoteric surfactants are, for example, alkylbetaines, alkylamidopropylbetaines, alkylsulfobetaines, alkyl glycinates, alkyl carboxyglycinates, alkyl amphoacetates or -propionates, alkyl amphodiacetates or -dipropionates.

For example, cocodimethylsulfopropylbetaine, laurylbetaine, cocamidopropylbetaine or sodium cocamphopropionate can be used.

Suitable nonionic surfactants are, for example, the reaction products of aliphatic alcohols or alkylphenols having 6 to 20 carbon atoms in the alkyl chain, which may be linear or branched, with ethylene oxide and/or propylene oxide. The amount of alkylene oxide is about 6 to 60 moles per mole of alcohol. Also suitable are alkylamine oxides, mono- or dialkylalkanolamides, fatty acid esters of polyethylene glycols, alkyl polyglycosides or sorbitan ether esters.

Furthermore, the shampoo formulations can comprise customary cationic surfactants, such as, for example, quaternary ammonium compounds, for example cetyltrimethylammonium chloride.

To achieve certain effects, customary conditioners can be used in combination with the peptides according to the invention in the shampoo formulations.

These include, for example, the abovementioned cationic polymers with the INCI name Polyquaternium, in particular copolymers of vinylpyrrolidone/N-vinylimidazolium salts (Luviquat FC, Luviquat HM, Luviquat MS, Luviquat Care), copolymers of N-vinylpyrrolidone/dimethylaminoethyl methacrylate, quaternized with diethyl sulfate (Luviquat D PQ 11), copolymers of N-vinylcaprolactam/N-vinylpyrrolidone/N-vinylimidazolium salts (Luviquat D Hold), cationic cellulose derivatives (Polyquaternium-4 and -10), acrylamide copolymers (Polyquaternium-7). In addition, protein hydrolyzates can be used, and also conditioning substances based on silicone compounds, for example polyalkylsiloxanes, polyarylsiloxanes, polyarylalkylsiloxanes, polyether siloxanes or silicone resins. Further suitable silicone compounds are dimethicone copolyols (CTFA) and aminofunctional silicone compounds such as amodimethicones (CTFA). In addition, cationic guar derivatives, such as guar hydroxypropyltrimonium chloride (INCI) can be used.

The invention will now be illustrated further by reference to the following nonlimiting examples.

EXPERIMENTAL SECTION

1. Test Examples A

Example 1

Inhibition of *Malassezia furfur* by P18

Growth medium: M472-Pitysporum medium according to DSMZ
40 g/l malt extract
20 g/l ox bile
10 g/l Tween 40

The components were sterilized at 121° C., 1 bar superatmospheric pressure for 20 minutes.

2 g/l of olive oil were sterilized by filtration and, after autoclaving, added to the other components.

Since it was a two-phase medium, the complete medium was treated with sonication in order to enlarge the phase boundary.

For agar plates, if appropriate, 150 g/l of agar agar were added to the medium.

The growth test was carried out as follows: A shake flask with M472-Pitysporum medium was inoculated with *M. furfur* and incubated with shaking overnight at 30° C. and 200 rpm.

A 96-well microtiter plate was filled with in each case 100 μl of M472-Pitysporum medium and inoculated with *M. furfur* suspension of the overnight culture. The *M. furfur* suspension was adjusted at the start of the experiment to an optical density, measured at 620 nm, of 0.02. The concentrates of the inhibitor solutions were 1 mM in water or DMSO.

The growth of the following batches was compared by measuring the optical density:

*M. furfur* suspension without the addition of an inhibitor.

*M. furfur* suspension without the addition of an inhibitor, but the addition of 2.5 μl of DMSO, which is comparable with the remaining experiments. This was to exclude that an inhibition is attributable merely to the effect of the DMSO, or a false positive result being observed.

*M. furfur* suspension and addition of an aqueous P18 solution with a final concentration of 25 μM.

*M. furfur* suspension and addition of a P18 solution in DMSO with a final concentration of 25 μM.

*M. furfur* suspension and addition of a zinc pyrithione (ZPT, Sigma-Aldrich) solution in DMSO with a final concentration of 25 μM.

*M. furfur* suspension and addition of a Ketoconazole (Sigma-Aldrich) solution in DMSO with a final concentration of 25 μM.

The microtiter plate was incubated with shaking at 30° C.

The growth was observed over 40 hours by measuring the optical density. The colony-forming units (CFU) were then determined by plating out 10 μl from each of the suspensions and, after incubation for 6 days, counting the colonies. The CFU was determined in order to exclude an influence of the two-phase medium and also the growth form of *M. furfur* on the optical density. However, in all of the experiments, the CFU correlated with the measured growth curves. The CFU measurement was helpful in order to detect weak growth compared to no measurable growth. The experiments were carried out at least in triple determinations and independently repeated. The results of one example experiment are summarized in Tables 1 and 2.

TABLE 1

Measurement of the optical density

| Incubation time [h] | without inhib. | without inhib. with DMSO | Addition of aqueous P18 solution [25 μM] | Addition of P18 solution in DMSO [25 μM] | Addition of ZPT solution in DMSO [25 μM] | Addition of Ketoconazole solution in DMSO [25 μM] |
|---|---|---|---|---|---|---|
| 0 | 0 | 0 | 0 | 0 | 0 | 0 |
| 16 | 0 | 0 | 0 | 0 | 0 | 0 |
| 24 | 0.21 | 0.12 | 0 | 0 | 0 | 0.004 |
| 40 | 0.42 | 0.25 | 0 | 0 | 0 | 0.013 |

TABLE 2

Counting the colony-forming units

| Incubation time [h] | without inhib. | without inhib. with DMSO | Addition of aqueous P18 solution [25 μM] | Addition of P18 solution in DMSO [25 μM] | Addition of ZPT solution in DMSO [25 μM] | Addition of Ketoconazole solution in DMSO [25 μM] |
|---|---|---|---|---|---|---|
| 16 | >10 000 | >10 000 | 62 | 8 | 42 | 80 |
| 24 | >10 000 | >10 000 | 41 | 0 | 22 | 22 |
| 40 | >10 000 | >10 000 | 120 | 0 | 28 | 90 |

The measurements for the optical density and the CFU show that the growth of *M. furfur* is effectively inhibited over the observed time period. Up to 40 hours, this inhibition was more effective compared to active ingredients such as zinc pyrithione (ZPT) or Ketoconazole.

Example 2

Inhibition of *Malassezia furfur* by P18 Compared to Magainin 2 and Cecropin A

The fusion peptide P18 is derived from magainin 2 and cecropin A. It was therefore investigated whether P18 more effectively inhibits the growth of *Malassezia furfur* than magainin 2 or cecropin A alone. For this, the procedure was as described in Example 1. 1 mM stock solutions of the fusion peptide P18, magainin 2 and cecropin A in DMSO were prepared. The final concentrations of the peptides in the growth experiments were 25 μM. The same amount of DMSO was likewise added to the suspension without inhibitor in order to exclude a growth-inhibiting effect of the DMSO.

The growth of the following mixtures was compared by measuring the optical density:

*M. furfur* suspension without the addition of an inhibitor, but with the addition of 2.5 μl of DMSO, which is comparable with the remaining experiments. This was to exclude that an inhibition is attributable merely to the effect of the DMSO.

*M. furfur* suspension and addition of a magainin 2 solution in DMSO with a final concentration of 25 μM.

*M. furfur* suspension and addition of a cecropin A solution in DMSO with a final concentration of 25 μM.

*M. furfur* suspension and addition of a peptide P18 (SEQ ID NO$_3$) solution in DMSO with a final concentration of 25 μM.

The experimental results of an example experiment are summarized in Table 3 below.

TABLE 3

CFU comparison of P18, magainin 2 and cecropin A

| Incubation time [h] | without inhib. with DMSO | Addition of magainin 2 solution in DMSO [25 μM] | Addition of Cecropin A solution in DMSO [25 μM] | Addition of P18 solution in DMSO [25 μM] |
|---|---|---|---|---|
| 64 | >10 000 | >10 000 | >5000 | 0 |
| 72 | >10 000 | >10 000 | >5000 | 23 |

It was found that the peptide P18 inhibits the growth of *M. furfur* more effectively than magainin 2 or cecropin A alone.

Example 3

Long-Term Stability of P18

The long-term stability of P18 was observed over a period of 2 weeks. For this, a 1 mM P18 solution in water was incubated at 37° C. over the entire period. At the start of the experiment and then on these two weeks, the antimicrobial activity was detected through inhibition of the growth of *Escherichia coli*. The growth medium used here was LB medium as complex medium. The medium comprised 10 g of trypton, 5 g of yeast extract and 10 g of NaCl per liter.

The growth test was carried out as follows: A shake flask of LB medium was inoculated with *Escherichia coli* and incubated overnight with shaking at 37° C. and 200 rpm. A 96-well microtiter plate was filled with in each case 100 μl of LB medium and inoculated with *E. coli* suspension of the overnight culture. The *E. coli* suspension was adjusted at the start of the experiment to an optical density, measured at 620 nm, of about 0.02. The concentrates of the P18 inhibitor solutions were 1 mM in water.

The growth of the following mixtures was compared by measuring the optical density:

*E. coli* suspension without the addition of an inhibitor.

*E. coli* suspension and addition of an aqueous P18 solution with a final concentration of 25 μM. The aqueous P18 solution had been freshly prepared.

E. coli suspension and addition of an aqueous P18 solution with a final concentration of 25 µM. The aqueous stock solution had been incubated for 2 weeks at 37° C.

The growth was observed over a period of 40 hours by measuring the optical density. It was found that the antimicrobial activity was unchanged even after incubation for 2 weeks at 37° C. and effectively inhibited the growth of *E. coli* over a period of 40 hours. The results are summarized in Table 4.

TABLE 4

Long-term stability, measured via the optical density at 620 nm

| Incubation time [h] | Sterile LB medium | E. coli suspension without inhib. | Addition of fresh aqueous P18 solution [25 µM] | Addition of stored aqueous P18 solution [25 µM] |
|---|---|---|---|---|
| 0 | 0 | 0.017 | 0.098 | 0.081 |
| 16 | 0 | 0.656 | 0 | 0 |
| 24 | 0 | 0.546 | 0 | 0 |
| 40 | 0 | 0.508 | 0 | 0 |

Example 4

Biodegradability of P18

Firstly, the peptide P18 was digested by adding chymotrypsin (from bovine pancreas, Sigma). For this, a 1 mM P18 solution was prepared and treated in accordance with the manufacturer's instructions. The samples were incubated for 16 hours at 37° C. The negative control used was a sample of a P18 solution without addition of chymotrypsin or a control solution which comprised only chymotrypsin, but no P18. The antimicrobial activity of P18 on *E. coli* cells was then investigated. The test was carried out as described in Example 3.

The growth of the following mixtures was compared by measuring the optical density:

*E. coli* suspension without the addition of an inhibitor.

*E. coli* suspension and addition of an aqueous P18 solution with a final concentration of 10 µM. The P18 solution had been stored beforehand for 16 hours at 37° C.

*E. coli* suspension and addition of an aqueous P18 solution with a final concentration of 10 µM. The P18 solution had been stored beforehand in accordance with the manufacturer's instructions for 16 hours at 37° C. and treated with chymotrypsin.

*E. coli* suspension and addition of an aqueous chymotrypsin solution which comprised, as control, the same amount of chymotrypsin as the P18 solution which was digested with chymotrypsin. This solution too had been stored beforehand for 16 hours at 37° C. This mixture was chosen in order to exclude an antimicrobial effect of the chymotrypsin.

The growth was observed over a period of 16 hours by measuring the optical density. It was found that the optical density of all samples developed similarly, i.e. microbial growth took place. Only the mixture to which undigested P18 solution had been added exhibited no or strongly inhibited microbial growth. These results show that a digestion of P18 with a serine protease, such as, for example, chymotrypsin, is possible, and demonstrate the biodegradability of the peptide. The results are summarized in Table 5.

TABLE 5

Biodegradability measured via the optical density at 620 nm in two independent experiments

| Incubation time [h] | E. coli suspension without inhib. | Addition of aqueous P18 solution [10 µM] | Addition of aqueous P18 solution [10 µM] digested with chymotrypsin | Addition of chymotrypsin control solution |
|---|---|---|---|---|
| 0 | 0.01-0.008 | 0-0 | 0.01-0 | 0.02-0.01 |
| 16 | 0.6-0.49 | 0.01-0.09 | 0.64-0.63 | 0.58-0.54 |

Example 5

Inhibition of Gram-Positive and Gram-Negative Bacteria

The growth inhibition by P18 was investigated on Gram-positive and Gram-negative bacteria. Shin et al. 1999 (loc.cit.) had already detected an inhibition on the model organisms *Escherichia coli* and *Bacillus subtilis* within a period up to 18 hours. However, growth experiments in this paper showed that an inhibition by P18 acts differently on Gram-positive and Gram-negative bacteria.

The growth medium used for this was LB medium as complex medium for the organisms *Escherichia coli*, *Bacillus subtilis* and *Brevibacterium epidermidis*. The medium comprised 10 g of trypton, 5 g of yeast extract and 10 g of NaCl per liter.

The growth test was carried out as follows: A shake flask with medium was inoculated with *Escherichia coli*, *Bacillus subtilis* or *Brevibacterium epidermidis* and incubated with shaking overnight at 30° C. and 200 rpm. A 96-well microtiter plate was filled with in each case 100 µl LB medium and inoculated with *E.-coli*, *B.-subtilis* or *B. epidermidis* suspensions of the overnight culture. The bacteria suspension was adjusted at the start of the experiment to an optical density, measured at 620 nm, of about 0.02. The concentrates of the P18 inhibitor solutions were 1 mM in water.

The growth of the following mixtures was compared by measuring the optical density:

bacteria suspension without the addition of an inhibitor;

bacteria suspension and addition of an aqueous P18 solution with a final concentration of 25 µM. The aqueous P18 solution had been freshly prepared.

The growth was observed over a period of 40 hours by measuring the optical density. It was found that P18 effectively inhibited the growth of the Gram-negative *E. coli* over this period. The growth of Gram-positive bacteria was inhibited initially. Within the experimental period of 40 hours, however, the model organisms *B. subtilis* and *B. epidermidis* inhibited with P18 achieved growth densities comparable with the noninhibited culture. These results suggest a different effect of P18 on Gram-positive and Gram-negative organisms. This property is advantageous since the human skin flora is preferably populated by Gram-positive bacteria and consequently an application of P18 does not disrupt this in the long term. The results are summarized in Table 6 below.

TABLE 6

Comparison of the growth of Gram-negative and Gram-positive model organisms, measured by the optical density at 620 nm (n.d. not measured).

| Incubation time [h] | E. coli suspension without inhib. | E. coli suspension with inhib. [25 µM P18 solution] | B. subtilis suspension without inhib. | B. subtilis suspension with inhib. [25 µM P18 solution] | B. epidermidis suspension without inhib. | B. epidermidis suspension with inhib. [25 µM P18 solution] |
|---|---|---|---|---|---|---|
| 16 | 0.5 | 0.09 | 0.77 | 0.25 | 0.85 | 0.29 |
| 24 | 0.68 | 0.06 | 0.71 | 0.96 | 1.11 | 0.56 |
| 40 | 0.84 | 0.07 | 0.76 | 0.67 | 1.39 | 1.24 |

The values given are mean values from 8 mixtures.

2. Formulation Examples A

Dermocosmetic preparations comprising the peptide P18 are described below. The peptide P18 is specified in the examples below by way of representation of all of the other peptides described above. It will be appreciated by the person skilled in the art that all of the other specified peptides according to the invention can also be used in the preparations given below.

AI=Active ingredient

Example 6

Use of P18 in an emulsion for day care—O/W type

AI 1%:

| | % | Ingredient (INCI) |
|---|---|---|
| A | 1.7 | Ceteareth-6, stearyl alcohol |
| | 0.7 | Ceteareth-25 |
| | 2.0 | Diethylaminohydroxybenzoylhexyl benzoate |
| | 2.0 | PEG-14 dimethicon |
| | 3.6 | Cetearyl alcohol |
| | 6.0 | Ethylhexyl methoxycinnamate |
| | 2.0 | Dibutyl adipate |
| B | 5.0 | Glycerol |
| | 0.2 | Disodium EDTA |
| | 1.0 | Panthenol |
| | q.s. | Preservative |
| | 67.8 | Aqua dem. |
| C | 4.0 | Caprylic/capric triglyceride, sodium acrylate copolymer |
| D | 0.2 | Sodium ascorbyl phosphate |
| | 1.0 | Tocopheryl acetate |
| | 0.2 | Bisabolol |
| | 1.0 | Caprylic/capric triglyceride, sodium ascorbate, tocopherol, retinol |
| | 1.0 | Aqueous solution with about 7% P18 |
| E | q.s. | Sodium hydroxide |

AI 5%:

| | % | Ingredient (INCI) |
|---|---|---|
| A | 1.7 | Ceteareth-6, stearyl alcohol |
| | 0.7 | Ceteareth-25 |
| | 2.0 | Diethylaminohydroxybenzoylhexyl benzoate |
| | 2.0 | PEG-14 dimethicone |
| | 3.6 | Cetearyl alcohol |
| | 6.0 | Ethylhexyl methoxycinnamate |
| | 2.0 | Dibutyl adipate |
| B | 5.0 | Glycerol |
| | 0.2 | Disodium EDTA |
| | 1.0 | Panthenol |
| | q.s. | Preservative |
| | 63.8 | Aqua dem. |
| C | 4.0 | Caprylic/capric triglyceride, sodium acrylate copolymer |
| D | 0.2 | Sodium ascorbyl phosphate |
| | 1.0 | Tocopheryl acetate |
| | 0.2 | Bisabolol |
| | 1.0 | Caprylic/capric triglyceride, sodium ascorbate, tocopherol, retinol |
| | 5.0 | Aqueous solution with about 7% P18 |
| E | q.s. | Sodium hydroxide |

Preparation: Heat phases A and B separately from one another to about 80° C. Stir phase B into phase A and homogenize. Stir phase C into the combined phases A and B and homogenize again. Cool, with stirring, to about 40° C., add phase D, adjust the pH to about 6.5 with phase E, homogenize and cool to room temperature with stirring.

The formulation is prepared without protective gas. Bottling must be into oxygen-impermeable packagings, e.g. aluminum tubes.

Example 7

Use of P18 in a protective day cream—O/W type

AI 1%:

| | % | Ingredient (INCI) |
|---|---|---|
| A | 1.7 | Ceteareth-6, stearyl alcohol |
| | 0.7 | Ceteareth-25 |
| | 2.0 | Diethylaminohydroxybenzoylhexyl benzoate |
| | 2.0 | PEG-14 dimethicone |
| | 3.6 | Cetearyl alcohol |
| | 6.0 | Ethylhexyl methoxycinnamate |
| | 2.0 | Dibutyl adipate |
| B | 5.0 | Glycerol |
| | 0.2 | Disodium EDTA |
| | 1.0 | Panthenol |
| | q.s. | Preservative |
| | 68.6 | Aqua dem. |
| C | 4.0 | Caprylic/capric triglyceride, sodium acrylate copolymer |
| D | 1.0 | Sodium ascorbyl phosphate |
| | 1.0 | Tocopheryl acetate |
| | 0.2 | Bisabolol |
| | 1.0 | Aqueous solution with about 7% P18 |
| E | q.s. | Sodium hydroxide |

AI 5%:

| | % | Ingredient (INCI) |
|---|---|---|
| A | 1.7 | Ceteareth-6, stearyl alcohol |
| | 0.7 | Ceteareth-25 |
| | 2.0 | Diethylaminohydroxybenzoylhexyl benzoate |

-continued

|   | % | Ingredient (INCI) |
|---|---|---|
|   | 2.0 | PEG-14 dimethicone |
|   | 3.6 | Cetearyl alcohol |
|   | 6.0 | Ethylhexyl methoxycinnamate |
|   | 2.0 | Dibutyl adipate |
| B | 5.0 | Glycerol |
|   | 0.2 | Disodium EDTA |
|   | 1.0 | Panthenol |
|   | q.s. | Preservative |
|   | 64.6 | Aqua dem. |
| C | 4.0 | Caprylic/capric triglyceride, sodium acrylate copolymer |
| D | 1.0 | Sodium ascorbyl phosphate |
|   | 1.0 | Tocopheryl acetate |
|   | 0.2 | Bisabolol |
|   | 5.0 | Aqueous solution with about 7% P18 |
| E | q.s. | Sodium hydroxide |

Preparation: Heat phases A and B separately from one another to about 80° C. Stir phase B into phase A and homogenize. Incorporate phase C into the combined phases A and B and homogenize. Cool, with stirring, to about 40° C. Add phase D, adjust the pH to about 6.5 with phase E and homogenize. Cool to room temperature with stirring.

Example 8

Use of P18 in a Face Cleansing Lotion—O/W type

AI 1%:

|   | % | Ingredient (INCI) |
|---|---|---|
| A | 10.0 | Cetearyl ethylhexanoate |
|   | 10.0 | Caprylic/capric triglyceride |
|   | 1.5 | Cyclopentasiloxane, cyclohexasiloxane |
|   | 2.0 | PEG-40-hydrogenated castor oil |
| B | 3.5 | Caprylic/capric triglyceride, sodium acrylate copolymer |
| C | 1.0 | Tocopheryl acetate |
|   | 0.2 | Bisabolol |
|   | q.s. | Preservative |
|   | q.s. | Perfume oil |
| D | 3.0 | Polyquaternium-44 |
|   | 0.5 | Cocotrimonium methosulfate |
|   | 0.5 | Ceteareth-25 |
|   | 2.0 | Panthenol, propylene glycol |
|   | 4.0 | Propylene glycol |
|   | 0.1 | Disodium EDTA |
|   | 1.0 | Aqueous solution with about 7% P18 |
|   | 60.7 | Aqua dem. |

AI 5%:

|   | % | Ingredient (INCI) |
|---|---|---|
| A | 10.0 | Cetearyl ethylhexanoate |
|   | 10.0 | Caprylic/capric triglyceride |
|   | 1.5 | Cyclopentasiloxane, cyclohexasiloxane |
|   | 2.0 | PEG-40-hydrogenated castor oil |
| B | 3.5 | Caprylic/capric triglyceride, sodium acrylate copolymer |
| C | 1.0 | Tocopheryl acetate |
|   | 0.2 | Bisabolol |
|   | q.s. | Preservative |
|   | q.s. | Perfume oil |
| D | 3.0 | Polyquaternium-44 |
|   | 0.5 | Cocotrimonium methosulfate |
|   | 0.5 | Ceteareth-25 |
|   | 2.0 | Panthenol, propylene glycol |
|   | 4.0 | Propylene glycol |
|   | 0.1 | Disodium EDTA |
|   | 5.0 | Aqueous solution with about 7% P18 |
|   | 56.7 | Aqua dem. |

Preparation: Dissolve phase A. Stir phase B into phase A, incorporate phase C into the combined phases A and B. Dissolve phase D, stir into the combined phases A, B and C and homogenize. Afterstir for 15 min.

Example 9

Use of P18 in a Daily Care Body Spray

AI 1%:

|   | % | Ingredient (INCI) |
|---|---|---|
| A | 3.0 | Ethylhexyl methoxycinnamate |
|   | 2.0 | Diethylaminohydroxybenzoylhexyl benzoate |
|   | 1.0 | Polyquaternium-44 |
|   | 3.0 | Propylene glycol |
|   | 2.0 | Panthenol, propylene glycol |
|   | 1.0 | Cyclopentasiloxane, cyclohexasiloxane |
|   | 10.0 | Octyldodecanol |
|   | 0.5 | PVP |
|   | 10.0 | Caprylic/capric triglyceride |
|   | 3.0 | $C_{12-15}$-Alkyl benzoate |
|   | 3.0 | Glycerol |
|   | 1.0 | Tocopheryl acetate |
|   | 0.3 | Bisabolol |
|   | 1.0 | Aqueous solution with about 7% P18 |
|   | 59.2 | Alcohol |

AI 5%:

|   | % | Ingredient (INCI) |
|---|---|---|
| A | 3.0 | Ethylhexyl methoxycinnamate |
|   | 2.0 | Diethylaminohydroxybenzoylhexyl benzoate |
|   | 1.0 | Polyquaternium-44 |
|   | 3.0 | Propylene glycol |
|   | 2.0 | Panthenol, propylene glycol |
|   | 1.0 | Cyclopentasiloxane, cyclohexasiloxane |
|   | 10.0 | Octyldodecanol |
|   | 0.5 | PVP |
|   | 10.0 | Caprylic/capric triglyceride |
|   | 3.0 | $C_{12-15}$-Alkyl benzoate |
|   | 3.0 | Glycerol |
|   | 1.0 | Tocopheryl acetate |
|   | 0.3 | Bisabolol |
|   | 5.0 | Aqueous solution with about 7% P18 |
|   | 55.2 | Alcohol |

Preparation: Weigh in the components of phase A and dissolve to give a clear solution.

Example 10

Use of P18 in a Skincare Gel

AI 1%:

|   | % | Ingredient (INCI) |
|---|---|---|
| A | 3.6 | PEG-40-hydrogenated castor oil |
|   | 15.0 | Alcohol |
|   | 0.1 | Bisabolol |
|   | 0.5 | Tocopheryl acetate |
|   | q.s. | Perfume oil |
| B | 3.0 | Panthenol |
|   | 0.6 | Carbomer |
|   | 1.0 | Aqueous solution with about 7% P18 |
|   | 75.4 | Aqua dem. |
| C | 0.8 | Triethanolamine |

AI 5%:

|   | %    | Ingredient (INCI)             |
|---|------|-------------------------------|
| A | 3.6  | PEG-40-hydrogenated castor oil |
|   | 15.0 | Alcohol                       |
|   | 0.1  | Bisabolol                     |
|   | 0.5  | Tocopheryl acetate            |
|   | q.s. | Perfume oil                   |
| B | 3.0  | Panthenol                     |
|   | 0.6  | Carbomer                      |
|   | 5.0  | Aqueous solution with about 7% P18 |
|   | 71.4 | Aqua dem.                     |
| C | 0.8  | Triethanolamine               |

Preparation: Dissolve phase A to give a clear solution. Allow phase B to swell and neutralize with phase C. Stir phase A into the homogenized phase B and homogenize.

Example 11

Use of P18 in an Aftershave Lotion

AI 1%:

|   | %    | Ingredient (INCI)             |
|---|------|-------------------------------|
| A | 10.0 | Cetearyl ethylhexanoate       |
|   | 5.0  | Tocopheryl acetate            |
|   | 1.0  | Bisabolol                     |
|   | 0.1  | Perfume oil                   |
|   | 0.3  | Acrylates/$C_{10-30}$ alkyl acrylate crosspolymer |
| B | 15.0 | Alcohol                       |
|   | 1.0  | Panthenol                     |
|   | 3.0  | Glycerol                      |
|   | 1.0  | Aqueous solution with about 7% P18 |
|   | 0.1  | Triethanolamine               |
|   | 63.5 | Aqua dem.                     |

AI 5%:

|   | %    | Ingredient (INCI)             |
|---|------|-------------------------------|
| A | 10.0 | Cetearyl ethylhexanoate       |
|   | 5.0  | Tocopheryl acetate            |
|   | 1.0  | Bisabolol                     |
|   | 0.1  | Perfume oil                   |
|   | 0.3  | Acrylates/$C_{10-30}$ alkyl acrylate crosspolymer |
| B | 15.0 | Alcohol                       |
|   | 1.0  | Panthenol                     |
|   | 3.0  | Glycerol                      |
|   | 5.0  | Aqueous solution with about 7% P18 |
|   | 0.1  | Triethanolamine               |
|   | 59.5 | Aqua dem.                     |

Preparation: Mix the components of phase A. Dissolve phase B, incorporate into phase A and homogenize.

Example 12

Use of P18 in an Aftersun Lotion

AI 1%:

|   | %    | Ingredient (INCI)             |
|---|------|-------------------------------|
| A | 0.4  | Acrylates/$C_{10-30}$-alkyl acrylate crosspolymer |
|   | 15.0 | Cetearyl ethylhexanoate       |
|   | 0.2  | Bisabolol                     |
|   | 1.0  | Tocopheryl acetate            |
|   | q.s. | Perfume oil                   |
| B | 1.0  | Panthenol                     |
|   | 15.0 | Alcohol                       |
|   | 3.0  | Glycerol                      |
|   | 1.0  | Aqueous solution with about 7% P18 |
|   | 63.2 | Aqua dem.                     |
| C | 0.2  | Triethanolamine               |

AI 5%:

|   | %    | Ingredient (INCI)             |
|---|------|-------------------------------|
| A | 0.4  | Acrylates/$C_{10-30}$ alkyl acrylate crosspolymer |
|   | 15.0 | Cetearyl ethylhexanoate       |
|   | 0.2  | Bisabolol                     |
|   | 1.0  | Tocopheryl acetate            |
|   | q.s. | Perfume oil                   |
| B | 1.0  | Panthenol                     |
|   | 15.0 | Alcohol                       |
|   | 3.0  | Glycerol                      |
|   | 5.0  | Aqueous solution with about 7% P18 |
|   | 59.2 | Aqua dem.                     |
| C | 0.2  | Triethanolamine               |

Preparation: Mix the components of phase A. Stir phase B into phase A with homogenization. Neutralize with phase C and homogenize again.

Example 13

Use of P18 in a Sunscreen Lotion

AI 1%:

|   | %    | Ingredient (INCI)             |
|---|------|-------------------------------|
| A | 4.5  | Ethylhexyl methoxycinnamate   |
|   | 2.0  | Diethylaminohydroxybenzoylhexyl benzoate |
|   | 3.0  | Octocrylene                   |
|   | 2.5  | Di-$C_{12-13}$-alkyl malate   |
|   | 0.5  | Tocopheryl acetate            |
|   | 4.0  | Polyglyceryl-3 methylglucose distearate |
| B | 3.5  | Cetearyl isononanoate         |
|   | 1.0  | VP/eicosene copolymer         |
|   | 5.0  | Isohexadecane                 |
|   | 2.5  | Di-$C_{12-13}$-alkyl malate   |
|   | 3.0  | Titanium dioxide, trimethoxycaprylylsilane |
| C | 5.0  | Glycerol                      |
|   | 1.0  | Sodium cetearyl sulfate       |
|   | 0.5  | Xanthan gum                   |
|   | 59.7 | Aqua dem.                     |
| D | 1.0  | Aqueous solution with about 7% P18 |
|   | 1.0  | Phenoxyethanol, methyl paraben, ethyl paraben, butyl paraben, propyl paraben, isobutyl paraben |
|   | 0.3  | Bisabolol                     |

AI 5%:

|   | %    | Ingredient (INCI)             |
|---|------|-------------------------------|
| A | 4.5  | Ethylhexyl methoxycinnamate   |
|   | 2.0  | Diethylaminohydroxybenzoylhexyl benzoate |
|   | 3.0  | Octocrylene                   |
|   | 2.5  | Di-$C_{12-13}$-alkyl malate   |
|   | 0.5  | Tocopheryl acetate            |
|   | 4.0  | Polyglyceryl-3 methylglucose distearate |
| B | 3.5  | Cetearyl isononanoate         |
|   | 1.0  | VP/eicosene copolymer         |
|   | 5.0  | Isohexadecane                 |
|   | 2.5  | Di-$C_{12-13}$-alkyl malate   |
|   | 3.0  | Titanium dioxide, trimethoxycaprylylsilane |

-continued

| | % | Ingredient (INCI) |
|---|---|---|
| C | 5.0 | Glycerol |
| | 1.0 | Sodium cetearyl sulfate |
| | 0.5 | Xanthan gum |
| | 55.7 | Aqua dem. |
| D | 5.0 | Aqueous solution with about 7% P18 |
| | 1.0 | Phenoxyethanol, methyl paraben, ethyl paraben, butyl paraben, propyl paraben, isobutyl paraben |
| | 0.3 | Bisabolol |

Preparation: Heat the components of phases A and B separately from one another to about 80° C. Stir phase B into phase A and homogenize. Heat phase C to about 80° C. and stir into the combined phases A and B with homogenization. Cool to about 40° C. with stirring, add phase D and homogenize again.

Example 14

Use of P18 in a Sunscreen Lotion—O/W Type

AI 1%

| | % | Ingredient (INCI) |
|---|---|---|
| A | 2.0 | Ceteareth-6, stearyl alcohol |
| | 2.0 | Ceteareth-25 |
| | 3.0 | Tribehenin |
| | 2.0 | Cetearyl alcohol |
| | 2.0 | Cetearyl ethylhexanoate |
| | 5.0 | Ethylhexyl methoxycinnamate |
| | 1.0 | Ethylhexyltriazone |
| | 1.0 | VP/eicosene copolymer |
| | 7.0 | Isopropyl myristate |
| B | 5.0 | Zinc oxide, triethoxycaprylylsilane |
| C | 0.2 | Xanthan gum |
| | 0.5 | Hydroxyethyl acrylate/sodium acryloyldimethyltaurate copolymer, squalane, polysorbate 60 |
| | 0.2 | Disodium EDTA |
| | 5.0 | Propylene glycol |
| | 0.5 | Panthenol |
| | 60.9 | Aqua dem. |
| D | 1.0 | Aqueous solution with about 7% P18 |
| | 0.5 | Phenoxyethanol, methyl paraben, ethyl paraben, butyl paraben, propyl paraben, isopropyl paraben |
| | 1.0 | Tocopheryl acetate |
| | 0.2 | Bisabolol |

AI 5%

| | % | Ingredient (INCI) |
|---|---|---|
| A | 2.0 | Ceteareth-6, Stearyl alcohol |
| | 2.0 | Ceteareth-25 |
| | 3.0 | Tribehenin |
| | 2.0 | Cetearyl alcohol |
| | 2.0 | Cetearyl ethylhexanoate |
| | 5.0 | Ethylhexyl methoxycinnamate |
| | 1.0 | Ethylhexyltriazone |
| | 1.0 | VP/eicosene copolymer |
| | 7.0 | Isopropyl myristate |
| B | 5.0 | Zinc oxide, triethoxycaprylylsilane |
| C | 0.2 | Xanthan gum |
| | 0.5 | Hydroxyethyl acrylate/sodium acryloyldimethyltaurate copolymer, squalane, polysorbate 60 |
| | 0.2 | Disodium EDTA |
| | 5.0 | Propylene glycol |
| | 0.5 | Panthenol |
| | 56.9 | Aqua dem. |

-continued

| | % | Ingredient (INCI) |
|---|---|---|
| D | 5.0 | Aqueous solution with about 7% P18 |
| | 0.5 | Phenoxyethanol, methyl paraben, ethyl paraben, butyl paraben, propyl paraben, isopropyl paraben |
| | 1.0 | Tocopheryl acetate |
| | 0.2 | Bisabolol |

Preparation: Heat phase A to about 80° C., stir in phase B and homogenize for 3 min. Likewise heat phase C to 80° C. and stir into the combined phases A and B with homogenization. Cool to about 40° C., stir in phase D and homogenize again.

Example 15

Use of P18 in a Sunscreen Lotion—O/W Type

AI 1%:

| | % | Ingredient (INCI) |
|---|---|---|
| A | 3.5 | Ceteareth-6, stearyl alcohol |
| | 1.5 | Ceteareth-25 |
| | 7.5 | Ethylhexyl methoxycinnamate |
| | 2.0 | Diethylaminohydroxybenzoylhexyl benzoate |
| | 2.0 | Cyclopentasiloxane, cyclohexasiloxane |
| | 0.5 | Beeswax |
| | 3.0 | Cetearyl alcohol |
| | 10.0 | Caprylic/capric triglyceride |
| B | 5.0 | Titanium dioxide, silicon dioxide, methicone, aluminum oxide |
| C | 3.0 | Glycerol |
| | 0.2 | Disodium EDTA |
| | 0.3 | Xanthan gum |
| | 1.0 | Decyl glucoside |
| | 2.0 | Panthenol, propylene glycol |
| | 56.3 | Aqua dem. |
| D | 1.0 | Aqueous solution with about 7% P18 |
| | 1.0 | Tocopheryl acetate |
| | 0.2 | Bisabolol |
| | q.s. | Perfume oil |
| | q.s. | Preservative |

AI 5%:

| | % | Ingredient (INCI) |
|---|---|---|
| A | 3.5 | Ceteareth-6, Stearyl alcohol |
| | 1.5 | Ceteareth-25 |
| | 7.5 | Ethylhexyl methoxycinnamate |
| | 2.0 | Diethylaminohydroxybenzoylhexyl benzoate |
| | 2.0 | Cyclopentasiloxane, cyclohexasiloxane |
| | 0.5 | Beeswax |
| | 3.0 | Cetearyl alcohol |
| | 10.0 | Caprylic/capric triglyceride |
| B | 5.0 | Titanium dioxide, silicon dioxide, methicone, aluminum oxide |
| C | 3.0 | Glycerol |
| | 0.2 | Disodium EDTA |
| | 0.3 | Xanthan gum |
| | 1.0 | Decyl glucoside |
| | 2.0 | Panthenol, propylene glycol |
| | 52.3 | Aqua dem. |
| D | 5.0 | Aqueous solution with about 7% P18 |
| | 1.0 | Tocopheryl acetate |
| | 0.2 | Bisabolol |
| | q.s. | Perfume oil |
| | q.s. | Preservative |

Preparation: Heat phase A to about 80° C., stir in phase B and homogenize for 3 min. Likewise heat phase C to 80° C.

and stir into the combined phases A and B with homogenization. Cool to about 40° C., stir in phase D and homogenize again.

Example 16

Use of P18 in a Foot Balm

AI 1%:

| | % | Ingredient (INCI) |
|---|---|---|
| A | 2.0 | Ceteareth-6, Stearyl alcohol |
| | 2.0 | Ceteareth-25 |
| | 5.0 | Cetearyl ethylhexanoate |
| | 4.0 | Cetyl alcohol |
| | 4.0 | Glyceryl stearate |
| | 5.0 | Mineral oil |
| | 0.2 | Menthol |
| | 0.5 | Camphor |
| B | 69.3 | Aqua dem. |
| | q.s. | Preservative |
| C | 1.0 | Bisabolol |
| | 1.0 | Tocopheryl acetate |
| D | 1.0 | Aqueous solution with about 7% P18 |
| | 5.0 | Witch hazel extract |

AI 5%:

| | % | Ingredient (INCI) |
|---|---|---|
| A | 2.0 | Ceteareth-6, Stearyl alcohol |
| | 2.0 | Ceteareth-25 |
| | 5.0 | Cetearyl ethylhexanoate |
| | 4.0 | Cetyl alcohol |
| | 4.0 | Glyceryl stearate |
| | 5.0 | Mineral oil |
| | 0.2 | Menthol |
| | 0.5 | Camphor |
| B | 65.3 | Aqua dem. |
| | q.s. | Preservative |
| C | 1.0 | Bisabolol |
| | 1.0 | Tocopheryl acetate |
| D | 5.0 | Aqueous solution with about 7% P18 |
| | 5.0 | Witch hazel extract |

Preparation: Heat the components of phases A and B separately from one another to about 80° C. Stir phase B into phase A with homogenization. With stirring, cool to about 40° C., add phases C and D and briefly afterhomogenize. With stirring, cool to room temperature.

Example 17

Use of P18 in a W/O Emulsion with Bisabolol

AI 1%:

| | % | Ingredient (INCI) |
|---|---|---|
| A | 6.0 | PEG-7-hydrogenated castor oil |
| | 8.0 | Cetearyl ethylhexanoate |
| | 5.0 | Isopropyl myristate |
| | 15.0 | Mineral oil |
| | 0.3 | Magnesium stearate |
| | 0.3 | Aluminum stearate |
| | 2.0 | PEG-45/dodecyl glycol copolymer |
| B | 5.0 | Glycerol |
| | 0.7 | Magnesium sulfate |
| | 55.6 | Aqua dem. |

-continued

| | % | Ingredient (INCI) |
|---|---|---|
| C | 1.0 | Aqueous solution with about 7% P18 |
| | 0.5 | Tocopheryl acetate |
| | 0.6 | Bisabolol |

AI 5%:

| | % | Ingredient (INCI) |
|---|---|---|
| A | 6.0 | PEG-7-hydrogenated castor oil |
| | 8.0 | Cetearyl ethylhexanoate |
| | 5.0 | Isopropyl myristate |
| | 15.0 | Mineral oil |
| | 0.3 | Magnesium stearate |
| | 0.3 | Aluminum stearate |
| | 2.0 | PEG-45/dodecyl glycol copolymer |
| B | 5.0 | Glycerol |
| | 0.7 | Magnesium sulfate |
| | 51.6 | Aqua dem. |
| C | 5.0 | Aqueous solution with about 7% P18 |
| | 0.5 | Tocopheryl acetate |

Preparation: Heat phases A and B separately from one another to about 85° C. Stir phase B into phase A and homogenize. With stirring, cool to about 40° C., add phase C and briefly homogenize again. With stirring, cool to room temperature.

Example 18

Foam Conditioner with Setting Agent

AI 1%:

| | % | Ingredient (INCI) |
|---|---|---|
| A | 10.0 | PVP/VA copolymer |
| | 0.2 | Hydroxyethylcetyldimonium phosphate |
| | 0.2 | Ceteareth-25 |
| | 0.5 | Dimethicone copolyol |
| | q.s. | Perfume oil |
| | 10.0 | Alcohol |
| | 1.0 | Aqueous solution with about 7% P18 |
| | 68.1 | Aqua dem. |
| | 10.0 | Propane/butane |

AI 5%:

| | % | Ingredient (INCI) |
|---|---|---|
| A | 10.0 | PVP/VA copolymer |
| | 0.2 | Hydroxyethylcetyldimonium phosphate |
| | 0.2 | Ceteareth-25 |
| | 0.5 | Dimethicone copolyol |
| | q.s. | Perfume oil |
| | 10.0 | Alcohol |
| | 5.0 | Aqueous solution with about 7% P18 |
| | 64.1 | Aqua dem. |
| | 10.0 | Propane/butane |

Preparation: Weigh the components of phase A together, stir until everything has dissolved, and bottle.

Example 19

Foam Conditioner

AI 1%:

|   | % | Ingredient (INCI) |
|---|---|---|
| A | 1.0 | Polyquaternium-4 |
|   | 0.5 | Hydroxyethylcetyldimonium phosphate |
|   | 1.0 | Aqueous solution with about 7% P18 |
|   | q.s. | Perfume oil |
|   | q.s. | Preservative |
|   | 91.5 | Aqua dem. |
|   | 6.0 | Propane/butane |

AI 5%:

|   | % | Ingredient (INCI) |
|---|---|---|
| A | 1.0 | Polyquaternium-4 |
|   | 0.5 | Hydroxyethylcetyldimonium phosphate |
|   | 5.0 | Aqueous solution with about 7% P18 |
|   | q.s. | Perfume oil |
|   | q.s. | Preservative |
|   | 87.5 | Aqua dem. |
|   | 6.0 | Propane/butane |

Preparation: Weigh the components of phase A together, stir until everything has dissolved to give a clear solution, and bottle.

Example 20

Foam Conditioner

AI 1%:

|   | % | Ingredient (INCI) |
|---|---|---|
| A | 1.0 | Polyquaternium-11 |
|   | 0.5 | Hydroxyethylcetyldimonium phosphate |
|   | 1.0 | Aqueous solution with about 7% P18 |
|   | q.s. | Perfume oil |
|   | q.s. | Preservative |
|   | 91.5 | Aqua dem. |
|   | 6.0 | Propane/butane |

AI 5%:

|   | % | Ingredient (INCI) |
|---|---|---|
| A | 1.0 | Polyquaternium-11 |
|   | 0.5 | Hydroxyethylcetyldimonium phosphate |
|   | 5.0 | Aqueous solution with about 7% P18 |
|   | q.s. | Perfume oil |
|   | q.s. | Preservative |
|   | 87.5 | Aqua dem. |
|   | 6.0 | Propane/butane |

Preparation: Weigh the components of phase A together, stir until everything has dissolved to give a clear solution, and bottle.

Example 21

Styling Foam

AI 1%:

|   | % | Ingredient (INCI) |
|---|---|---|
| A | 0.5 | Laureth-4 |
|   | q.s. | Perfume oil |
| B | 77.3 | Aqua dem. |
|   | 10.0 | Polyquaternium-28 |
|   | 1.0 | Aqueous solution with about 7% P18 |
|   | 0.5 | Dimethicone copolyol |
|   | 0.2 | Ceteareth-25 |
|   | 0.2 | Panthenol |
|   | 0.1 | PEG-25 PABA |
|   | 0.2 | Hydroxyethylcellulose |
| C | 10.0 | HFC 152 A |

AI 5%:

|   | % | Ingredient (INCI) |
|---|---|---|
| A | 0.5 | Laureth-4 |
|   | q.s. | Perfume oil |
| B | 73.3 | Aqua dem. |
|   | 10.0 | Polyquaternium-28 |
|   | 5.0 | Aqueous solution with about 7% P18 |
|   | 0.5 | Dimethicone copolyol |
|   | 0.2 | Ceteareth-25 |
|   | 0.2 | Panthenol |
|   | 0.1 | PEG-25 PABA |
|   | 0.2 | Hydroxyethylcellulose |
| C | 10.0 | HFC 152 A |

Preparation: Mix the components of phase A. Add the components of phase B one after the other and dissolve. Bottle with phase C.

Example 22

Styling Foam

AI 1%:

|   | % | Ingredient (INCI) |
|---|---|---|
| A | 2.0 | Cocotrimonium methosulfate |
|   | q.s. | Perfume oil |
| B | 78.5 | Aqua dem. |
|   | 6.7 | Acrylate copolymer |
|   | 0.6 | AMP |
|   | 1.0 | Aqueous solution with about 7% P18 |
|   | 0.5 | Dimethicone copolyol |
|   | 0.2 | Ceteareth-25 |
|   | 0.2 | Panthenol |
|   | 0.1 | PEG-25 PABA |
|   | 0.2 | Hydroxyethylcellulose |
| C | 10.0 | HFC 152 A |

AI 5%:

|   | % | Ingredient (INCI) |
|---|---|---|
| A | 2.0 | Cocotrimonium methosulfate |
|   | q.s. | Perfume oil |
| B | 74.5 | Aqua dem. |
|   | 6.7 | Acrylate copolymer |
|   | 0.6 | AMP |

-continued

|   | %    | Ingredient (INCI)                    |
|---|------|--------------------------------------|
|   | 5.0  | Aqueous solution with about 7% P18   |
|   | 0.5  | Dimethicone copolyol                 |
|   | 0.2  | Ceteareth-25                         |
|   | 0.2  | Panthenol                            |
|   | 0.1  | PEG-25 PABA                          |
|   | 0.2  | Hydroxyethylcellulose                |
| C | 10.0 | HFC 152 A                            |

Preparation: Mix the components of phase A. Add the components of phase B one after the other and dissolve. Bottle with phase C.

Example 23

Styling Foam

AI 1%:

|   | %     | Ingredient (INCI)                  |
|---|-------|------------------------------------|
| A | 2.0   | Cocotrimonium methosulfate         |
|   | q.s.  | Perfume oil                        |
| B | 7.70  | Polyquaternium-44                  |
|   | 1.0   | Aqueous solution with about 7% P18 |
|   | q.s.  | Preservative                       |
|   | 79.3  | Aqua dem.                          |
| C | 10.0  | Propane/butane                     |

AI 5%:

|   | %     | Ingredient (INCI)                  |
|---|-------|------------------------------------|
| A | 2.0   | Cocotrimonium methosulfate         |
|   | q.s.  | Perfume oil                        |
| B | 7.70  | Polyquaternium-44                  |
|   | 5.0   | Aqueous solution with about 7% P18 |
|   | q.s.  | Preservative                       |
|   | 75.3  | Aqua dem.                          |
| C | 10.0  | Propane/butane                     |

Preparation: Mix the components of phase A. Dissolve the components of phase B to give a clear solution, then stir phase B into phase A. Adjust the pH to 6-7, bottle with phase C.

Example 24

Styling Foam

AI 1%:

|   | %     | Ingredient (INCI)                                    |
|---|-------|------------------------------------------------------|
| A | 2.00  | Cocotrimonium methosulfate                           |
|   | q.s.  | Perfume oil                                          |
| B | 72.32 | Aqua dem.                                            |
|   | 2.00  | VP/acrylates/lauryl methacrylate copolymer           |
|   | 0.53  | AMP                                                  |
|   | 1.00  | Aqueous solution with about 7% P18                   |
|   | 0.20  | Ceteareth-25                                         |
|   | 0.50  | Panthenol                                            |
|   | 0.05  | Benzophenone-4                                       |
|   | 0.20  | Amodimethicone, cetrimonium chloride, trideceth-12   |
|   | 15.00 | Alcohol                                              |
| C | 0.20  | Hydroxyethylcellulose                                |
| D | 6.00  | Propane/butane                                       |

AI 5%:

|   | %     | Ingredient (INCI)                                    |
|---|-------|------------------------------------------------------|
| A | 2.00  | Cocotrimonium methosulfate                           |
|   | q.s.  | Perfume oil                                          |
| B | 68.32 | Aqua dem.                                            |
|   | 2.00  | VP/acrylates/lauryl methacrylate copolymer           |
|   | 0.53  | AMP                                                  |
|   | 5.00  | Aqueous solution with about 7% P18                   |
|   | 0.20  | Ceteareth-25                                         |
|   | 0.50  | Panthenol                                            |
|   | 0.05  | Benzophenone-4                                       |
|   | 0.20  | Amodimethicone, cetrimonium chloride, trideceth-12   |
|   | 15.00 | Alcohol                                              |
| C | 0.20  | Hydroxyethylcellulose                                |
| D | 6.00  | Propane/butane                                       |

Preparation: Mix the components of phase A. Add the components of phase B one after the other and dissolve. Dissolve phase C in the mixture of A and B, then adjust the pH to 6-7. Bottle with phase D.

Example 25

Styling Foam

AI 1%:

|   | %     | Ingredient (INCI)                                    |
|---|-------|------------------------------------------------------|
| A | 2.00  | Cetrimonium chloride                                 |
|   | q.s.  | Perfume oil                                          |
| B | 67.85 | Aqua dem.                                            |
|   | 7.00  | Polyquaternium-46                                    |
|   | 1.00  | Aqueous solution with about 7% P18                   |
|   | 0.20  | Ceteareth-25                                         |
|   | 0.50  | Panthenol                                            |
|   | 0.05  | Benzophenone-4                                       |
|   | 0.20  | Amodimethicone, cetrimonium chloride, trideceth-12   |
|   | 15.00 | Alcohol                                              |
| C | 0.20  | Hydroxyethylcellulose                                |
| D | 6.00  | Propane/butane                                       |

AI 5%:

|   | %     | Ingredient (INCI)                                    |
|---|-------|------------------------------------------------------|
| A | 2.00  | Cetrimonium chloride                                 |
|   | q.s.  | Perfume oil                                          |
| B | 63.85 | Aqua dem.                                            |
|   | 7.00  | Polyquaternium-46                                    |
|   | 5.00  | Aqueous solution with about 7% P18                   |
|   | 0.20  | Ceteareth-25                                         |
|   | 0.50  | Panthenol                                            |
|   | 0.05  | Benzophenone-4                                       |
|   | 0.20  | Amodimethicone, cetrimonium chloride, trideceth-12   |
|   | 15.00 | Alcohol                                              |
| C | 0.20  | Hydroxyethylcellulose                                |
| D | 6.00  | Propane/butane                                       |

Preparation: Mix the components of phase A. Add the components of phase B one after the other and dissolve. Dissolve phase C in the mixture of phase A and B, then adjust the pH to 6-7. Bottle with phase D.

Example 26

Styling Foam

AI 1%:

|   | %    | Ingredient (INCI)                  |
|---|------|------------------------------------|
| A | q.s. | PEG-40-hydrogenated castor oil     |
|   | q.s. | Perfume oil                        |
|   | 85.5 | Aqua dem.                          |
| B | 7.0  | Sodium polystyrenesulfonate        |
|   | 1.0  | Aqueous solution with about 7% P18 |
|   | 0.5  | Cetrimonium bromide                |
|   | q.s. | Preservative                       |
| C | 6.0  | Propane/butane                     |

AI 5%:

|   | %    | Ingredient (INCI)                  |
|---|------|------------------------------------|
| A | q.s. | PEG-40-hydrogenated castor oil     |
|   | q.s. | Perfume oil                        |
|   | 81.5 | Aqua dem.                          |
| B | 7.0  | Sodium polystyrenesulfonate        |
|   | 5.0  | Aqueous solution with about 7% P18 |
|   | 0.5  | Cetrimonium bromide                |
|   | q.s. | Preservative                       |
| C | 6.0  | Propane/butane                     |

Preparation: Solubilize phase A. Weigh phase B into phase A and dissolve to give a clear solution. Adjust the pH to 6-7, bottle with phase C.

Example 27

Styling Foam

AI 1%:

|   | %    | Ingredient (INCI)                  |
|---|------|------------------------------------|
| A | q.s. | PEG-40-hydrogenated castor oil     |
|   | q.s. | Perfume oil                        |
|   | 92.0 | Aqua dem.                          |
| B | 0.5  | Polyquaternium-10                  |
|   | 1.0  | Aqueous solution with about 7% P18 |
|   | 0.5  | Cetrimonium bromide                |
|   | q.s. | Preservative                       |
| C | 6.0  | Propane/butane                     |

AI 5%:

|   | %    | Ingredient (INCI)                  |
|---|------|------------------------------------|
| A | q.s. | PEG-40-hydrogenated castor oil     |
|   | q.s. | Perfume oil                        |
|   | 88.0 | Aqua dem.                          |
| B | 0.5  | Polyquaternium-10                  |
|   | 5.0  | Aqueous solution with about 7% P18 |
|   | 0.5  | Cetrimonium bromide                |
|   | q.s. | Preservative                       |
| C | 6.0  | Propane/butane                     |

Preparation: Solubilize phase A. Weigh phase B into phase A and dissolve to give a clear solution. Adjust the pH to 6-7, bottle with phase C.

Example 28

Styling Foam

AI 1%:

|   | %    | Ingredient (INCI)                  |
|---|------|------------------------------------|
| A | q.s. | PEG-40-hydrogenated castor oil     |
|   | q.s. | Perfume oil                        |
|   | 82.5 | Aqua dem.                          |
| B | 10.0 | Polyquaternium-16                  |
|   | 1.0  | Aqueous solution with about 7% P18 |
|   | 0.5  | Hydroxyethylcetyldimonium phosphate|
|   | q.s. | Preservative                       |
| C | 6.0  | Propane/butane                     |

AI 5%:

|   | %    | Ingredient (INCI)                  |
|---|------|------------------------------------|
| A | q.s. | PEG-40-hydrogenated castor oil     |
|   | q.s. | Perfume oil                        |
|   | 78.5 | Aqua dem.                          |
| B | 10.0 | Polyquaternium-16                  |
|   | 5.0  | Aqueous solution with about 7% P18 |
|   | 0.5  | Hydroxyethylcetyldimonium phosphate|
|   | q.s. | Preservative                       |
| C | 6.0  | Propane/butane                     |

Preparation: Solubilize phase A. Weigh phase B into phase A and dissolve to give a clear solution. Adjust the pH to 6-7, bottle with phase C.

Example 29

Styling Foam

AI 1%:

|   | %    | Ingredient (INCI)                  |
|---|------|------------------------------------|
| A | 2.0  | Cocotrimonium methosulfate         |
|   | q.s. | Perfume oil                        |
| B | 84.0 | Aqua dem.                          |
|   | 2.0  | Chitosan                           |
|   | 1.0  | Aqueous solution with about 7% P18 |
|   | 0.5  | Dimethicone copolyol               |
|   | 0.2  | Ceteareth-25                       |
|   | 0.2  | Panthenol                          |
|   | 0.1  | PEG-25 PABA                        |
|   | 10.0 | HFC 152 A                          |

AI 5%:

|   | %    | Ingredient (INCI)                  |
|---|------|------------------------------------|
| A | 2.0  | Cocotrimonium methosulfate         |
|   | q.s. | Perfume oil                        |
| B | 80.0 | Aqua dem.                          |
|   | 2.0  | Chitosan                           |
|   | 5.0  | Aqueous solution with about 7% P18 |
|   | 0.5  | Dimethicone copolyol               |
|   | 0.2  | Ceteareth-25                       |
|   | 0.2  | Panthenol                          |
|   | 0.1  | PEG-25 PABA                        |
|   | 10.0 | HFC 152 A                          |

Preparation: Mix the components of phase A. Add the components of phase B one after the other and dissolve. Bottle with phase C.

Example 30

Care Shampoo

AI 1%

|   | %    | Ingredient (INCI) |
|---|------|---|
| A | 30.0 | Sodium laureth sulfate |
|   | 6.0  | Sodium cocoamphoacetate |
|   | 6.0  | Cocamidopropylbetaine |
|   | 3.0  | Sodium laureth sulfate, glycol distearate, cocamide-MEA, laureth-10 |
|   | 1.0  | Aqueous solution with about 7% P18 |
|   | 7.7  | Polyquaternium-44 |
|   | 2.0  | Amodimethicone |
|   | q.s. | Perfume oil |
|   | q.s. | Preservative |
|   | 1.0  | Sodium chloride |
|   | 43.3 | Aqua dem. |
| B | q.s. | Citric acid |

AI 5%

|   | %    | Ingredient (INCI) |
|---|------|---|
| A | 30.0 | Sodium laureth sulfate |
|   | 6.0  | Sodium cocoamphoacetate |
|   | 6.0  | Cocamidopropylbetaine |
|   | 3.0  | Sodium laureth sulfate, glycol distearate, cocamide-MEA, laureth-10 |
|   | 5.0  | Aqueous solution with about 7% P18 |
|   | 7.7  | Polyquaternium-44 |
|   | 2.0  | Amodimethicone |
|   | q.s. | Perfume oil |
|   | q.s. | Preservative |
|   | 1.0  | Sodium chloride |
|   | 39.3 | Aqua dem. |
| B | q.s. | Citric acid |

Preparation: Mix the components of phase A and dissolve. Adjust the pH to 6-7 with citric acid.

Example 31

Shower Gel

AI 1%

|   | %    | Ingredient (INCI) |
|---|------|---|
| A | 40.0 | Sodium laureth sulfate |
|   | 5.0  | Decyl glucoside |
|   | 5.0  | Cocamidopropylbetaine |
|   | 1.0  | Aqueous solution with about 7% P18 |
|   | 1.0  | Panthenol |
|   | q.s. | Perfume oil |
|   | q.s. | Preservative |
|   | 2.0  | Sodium chloride |
|   | 46.0 | Aqua dem. |
| B | q.s. | Citric acid |

AI 5%

|   | %    | Ingredient (INCI) |
|---|------|---|
| A | 40.0 | Sodium laureth sulfate |
|   | 5.0  | Decyl glucoside |
|   | 5.0  | Cocamidopropylbetaine |
|   | 5.0  | Aqueous solution with about 7% P18 |
|   | 1.0  | Panthenol |
|   | q.s. | Perfume oil |
|   | q.s. | Preservative |
|   | 2.0  | Sodium chloride |
|   | 42.0 | Aqua dem. |
| B | q.s. | Citric acid |

Preparation: Mix the components of phase A and dissolve. Adjust the pH to 6-7 with citric acid.

Example 32

Shampoo

AI 1%

|   | %    | Ingredient (INCI) |
|---|------|---|
| A | 40.0 | Sodium laureth sulfate |
|   | 5.0  | Sodium $C_{12-15}$-pareth-15-sulfonate |
|   | 5.0  | Decyl glucoside |
|   | q.s. | Perfume oil |
|   | 0.1  | Phytantriol |
|   | 44.6 | Aqua dem. |
|   | 1.0  | Aqueous solution with about 7% P18 |
|   | 0.3  | Polyquaternium-10 |
|   | 1.0  | Panthenol |
|   | q.s. | Preservative |
|   | 1.0  | Laureth-3 |
|   | 2.0  | Sodium chloride |

AI 5%

|   | %    | Ingredient (INCI) |
|---|------|---|
| A | 40.0 | Sodium laureth sulfate |
|   | 5.0  | Sodium $C_{12-15}$-pareth-15-sulfonate |
|   | 5.0  | Decyl glucoside |
|   | q.s. | Perfume oil |
|   | 0.1  | Phytantriol |
|   | 40.6 | Aqua dem. |
|   | 5.0  | Aqueous solution with about 7% P18 |
|   | 0.3  | Polyquaternium-10 |
|   | 1.0  | Panthenol |
|   | q.s. | Preservative |
|   | 1.0  | Laureth-3 |
|   | 2.0  | Sodium chloride |

Preparation: Mix the components of phase A and dissolve. Adjust the pH to 6-7 with citric acid.

Example 33

Shampoo

AI 1%

|   | %    | Ingredient (INCI) |
|---|------|---|
| A | 15.0 | Cocamidopropylbetaine |
|   | 10.0 | Disodium cocoamphodiacetate |
|   | 5.0  | Polysorbate 20 |
|   | 5.0  | Decyl glucoside |
|   | q.s. | Perfume oil |

-continued

|   | % | Ingredient (INCI) |
|---|---|---|
|   | q.s. | Preservative |
|   | 1.0 | Aqueous solution with about 7% P18 |
|   | 0.15 | Guar hydroxypropyltrimonium chloride |
|   | 2.0 | Laureth-3 |
|   | 58.0 | Aqua dem. |
|   | q.s. | Citric acid |
| B | 3.0 | PEG-150 distearate |

AI 5%

|   | % | Ingredient (INCI) |
|---|---|---|
| A | 15.0 | Cocamidopropylbetaine |
|   | 10.0 | Disodium cocoamphodiacetate |
|   | 5.0 | Polysorbate 20 |
|   | 5.0 | Decyl glucoside |
|   | q.s. | Perfume oil |
|   | q.s. | Preservative |
|   | 5.0 | Aqueous solution with about 7% P18 |
|   | 0.15 | Guar hydroxypropyltrimonium chloride |
|   | 2.0 | Laureth-3 |
|   | 54.0 | Aqua dem. |
|   | q.s. | Citric acid |
| B | 3.0 | PEG-150 distearate |

Preparation: Weigh in the components of phase A and dissolve. Adjust the pH to 6-7. Add phase B and heat to about 50° C. With stirring, cool to room temperature.

Example 34

Moisturizing Bodycare Cream

AI 1%

|   | % | Ingredient (INCI) |
|---|---|---|
| A | 2.0 | Ceteareth-25 |
|   | 2.0 | Ceteareth-6, stearyl alcohol |
|   | 3.0 | Cetearyl ethylhexanoate |
|   | 1.0 | Dimethicone |
|   | 4.0 | Cetearyl alcohol |
|   | 3.0 | Glyceryl stearate SE |
|   | 5.0 | Mineral oil |
|   | 4.0 | *Simmondsia chinensis* (jojoba) seed oil |
|   | 3.0 | Mineral oil, lanolin alcohol |
| B | 5.0 | Propylene glycol |
|   | 1.0 | Aqueous solution with about 7% P18 |
|   | 1.0 | Panthenol |
|   | 0.5 | Magnesium aluminum silicate |
|   | q.s. | Preservative |
|   | 65.5 | Aqua dem. |
| C | q.s. | Perfume oil |
| D | q.s. | Citric acid |

AI 5%

|   | % | Ingredient (INCI) |
|---|---|---|
| A | 2.0 | Ceteareth-25 |
|   | 2.0 | Ceteareth-6, stearyl alcohol |
|   | 3.0 | Cetearyl ethylhexanoate |
|   | 1.0 | Dimethicone |
|   | 4.0 | Cetearyl alcohol |
|   | 3.0 | Glyceryl stearate SE |
|   | 5.0 | Mineral oil |
|   | 4.0 | *Simmondsia chinensis* (jojoba) seed oil |
|   | 3.0 | Mineral oil, lanolin alcohol |

-continued

|   | % | Ingredient (INCI) |
|---|---|---|
| B | 5.0 | Propylene glycol |
|   | 5.0 | Aqueous solution with about 7% P18 |
|   | 1.0 | Panthenol |
|   | 0.5 | Magnesium aluminum silicate |
|   | q.s. | Preservative |
|   | 61.5 | Aqua dem. |
| C | q.s. | Perfume oil |
| D | q.s. | Citric acid |

Preparation: Heat phases A and B separately to about 80° C. Briefly prehomogenize phase B, then stir phase B into phase A and homogenize again. Cool to about 40° C., add phase C and homogenize well again. Adjust the pH to 6-7 with citric acid.

Example 35

Moisturizing Bodycare Cream

AI 1%

|   | % | Ingredient (INCI) |
|---|---|---|
| A | 6.0 | PEG-7-hydrogenated castor oil |
|   | 10.0 | Cetearyl ethylhexanoate |
|   | 5.0 | Isopropyl myristate |
|   | 7.0 | Mineral oil |
|   | 0.5 | Shea butter (*Butyrospermum parkii*) |
|   | 0.5 | Aluminum stearate |
|   | 0.5 | Magnesium stearate |
|   | 0.2 | Bisabolol |
|   | 0.7 | Quaternium-18 hectorite |
| B | 5.0 | Dipropylene glycol |
|   | 0.7 | Magnesium sulfate |
|   | q.s. | Preservative |
|   | 62.9 | Aqua dem. |
|   | q.s. | Perfume oil |
| C | 1.0 | Aqueous solution with about 7% P18 |

AI 5%

|   | % | Ingredient (INCI) |
|---|---|---|
| A | 6.0 | PEG-7-hydrogenated castor oil |
|   | 10.0 | Cetearyl ethylhexanoate |
|   | 5.0 | Isopropyl myristate |
|   | 7.0 | Mineral oil |
|   | 0.5 | Shea butter (*Butyrospermum parkii*) |
|   | 0.5 | Aluminum stearate |
|   | 0.5 | Magnesium stearate |
|   | 0.2 | Bisabolol |
|   | 0.7 | Quaternium-18 hectorite |
| B | 5.0 | Dipropylene glycol |
|   | 0.7 | Magnesium sulfate |
|   | q.s. | Preservative |
|   | 58.9 | Aqua dem. |
|   | q.s. | Perfume oil |
| C | 5.0 | Aqueous solution with about 7% P18 |

Preparation: Heat phases A and B separately to about 80° C. Stir phase B into phase A and homogenize. With stirring, cool to about 40° C., add phase C and homogenize again. With stirring, allow to cool to room temperature.

Example 36

Liquid Make-Up—O/W Type

AI 1%

|   | % | Ingredient (INCI) |
|---|---|---|
| A | 2.0 | Ceteareth-6, stearyl alcohol |
|   | 2.0 | Ceteareth-25 |
|   | 6.0 | Glyceryl stearate |
|   | 1.0 | Cetyl alcohol |
|   | 8.0 | Mineral oil |
|   | 7.0 | Cetearyl ethylhexanoate |
|   | 0.2 | Dimethicone |
| B | 3.0 | Propylene glycol |
|   | 1.0 | Panthenol |
|   | q.s. | Preservative |
|   | 61.9 | Aqua dem. |
| C | 0.1 | Bisabolol |
|   | 1.0 | Aqueous solution with about 7% P18 |
|   | q.s. | Perfume oil |
| D | 5.7 | C.I. 77 891, titanium dioxide |
|   | 1.1 | Iron oxides |

AI 5%

|   | % | Ingredient (INCI) |
|---|---|---|
| A | 2.0 | Ceteareth-6, stearyl alcohol |
|   | 2.0 | Ceteareth-25 |
|   | 6.0 | Glyceryl stearate |
|   | 1.0 | Cetyl alcohol |
|   | 8.0 | Mineral oil |
|   | 7.0 | Cetearyl ethylhexanoate |
|   | 0.2 | Dimethicone |
| B | 3.0 | Propylene glycol |
|   | 1.0 | Panthenol |
|   | q.s. | Preservative |
|   | 57.9 | Aqua dem. |
| C | 0.1 | Bisabolol |
|   | 5.0 | Aqueous solution with about 7% P18 |
|   | q.s. | Perfume oil |
| D | 5.7 | C.I. 77 891, titanium dioxide |
|   | 1.1 | Iron oxides |

Preparation: Heat phases A and B separately to about 80° C. Stir phase B into phase A and homogenize. With stirring, cool to about 40° C., add phases C and D and thoroughly homogenize again. With stirring, allow to cool to room temperature.

Example 37

Dermocosmetic Preparations

Dermocosmetic preparations according to the invention comprising the peptide P18 according to the invention are described below. The concentrations can vary according to the invention.
The data below are parts by weight.
(1) Clear Shampoo

| Ingredients (INCI) | 1 | 2 | 3 | 4 | 5 |
|---|---|---|---|---|---|
| Sodium laureth sulfate | 13.00 | 15.00 | 10.50 | 12.50 | 10.00 |
| Cocamidopropylbetaine | 7.50 | 7.00 | 5.00 | 5.50 | 10.00 |
| PEG-7 glyceryl cocoate | 2.00 | 2.50 | 3.50 | 5.00 | 2.30 |
| Perfume oil | 0.10 | 0.10 | 0.10 | 0.10 | 0.10 |
| P18 | 1.0 | 5.0 | 0.1 | 0.5 | 10.0 |
| D-Panthenol USP | 1.00 | 1.50 | 1.80 | 1.70 | 1.40 |

-continued

| Ingredients (INCI) | 1 | 2 | 3 | 4 | 5 |
|---|---|---|---|---|---|
| Preservative | 0.10 | 0.10 | 0.10 | 0.10 | 0.10 |
| Citric acid | 0.10 | 0.10 | 0.10 | 0.10 | 0.10 |
| Luviquat ® Ultra Care | 1.50 | 1.00 | 1.50 | 1.20 | 1.10 |
| Sodium chloride | 1.50 | 1.40 | 1.40 | 1.30 | 1.50 |
| Aqua dem. | ad 100 | ad 100 | ad 100 | ad 100 | ad 100 |

(2) Shampoo

| Ingredients (INCI) | 1 | 2 | 3 | 4 | 5 |
|---|---|---|---|---|---|
| Sodium laureth sulfate | 35.00 | 40.00 | 30.00 | 45.00 | 27.00 |
| Decyl glucoside | 5.00 | 5.50 | 4.90 | 3.50 | 7.00 |
| Cocamidopropylbetaine | 10.00 | 5.00 | 12.50 | 7.50 | 15.00 |
| Perfume oil | 0.10 | 0.10 | 0.10 | 0.10 | 0.10 |
| P18 | 1.0 | 5.0 | 0.1 | 0.5 | 10.0 |
| D-Panthenol USP | 0.50 | 1.00 | 0.80 | 1.50 | 0.50 |
| Preservative | 0.10 | 0.10 | 0.10 | 0.10 | 0.10 |
| Citric acid | 0.10 | 0.10 | 0.10 | 0.10 | 0.10 |
| Laureth-3 | 0.50 | 2.00 | 0.50 | 0.50 | 2.00 |
| Sodium chloride | 1.50 | 1.50 | 1.50 | 1.50 | 1.50 |
| Aqua dem. | ad 100 | ad 100 | ad 100 | ad 100 | ad 100 |

(3) Clear Conditioner-Shampoo

| Ingredients (INCI) | 1 | 2 | 3 | 4 | 5 |
|---|---|---|---|---|---|
| ® Disodium Cocoamphodiacetate | 10.00 | 15.00 | 20.00 | 12.00 | 17.00 |
| ® Decyl Glucoside | 5.00 | 6.00 | 7.00 | 8.00 | 4.00 |
| ® Cocamidopropyl Betaine | 15.00 | 12.00 | 10.00 | 18.00 | 20.00 |
| Luviquat ® FC 550 | 0.30 | 0.20 | 0.20 | 0.20 | 0.30 |
| Perfume oil | 0.10 | 0.10 | 0.10 | 0.10 | 0.10 |
| P18 | 20.0 | 5.0 | 1.0 | 0.5 | 10.0 |
| Cremophor ® PS 20 | 5.00 | 1.00 | 1.00 | 7.00 | 5.00 |
| Preservative | 0.10 | 0.10 | 0.10 | 0.10 | 0.10 |
| ® Laureth-3 | 2.00 | 1.00 | 0.50 | 2.00 | 2.00 |
| Citric acid | 0.20 | 0.20 | 0.20 | 0.20 | 0.20 |
| PEG-12 distearate | 3.00 | 2.00 | 2.00 | 3.00 | 2.50 |
| Aqua dem. | ad 100 | ad 100 | ad 100 | ad 100 | ad 100 |

(4) Foam O/W Emulsions

|   | Emulsion 1 % by wt. | % by vol. | Emulsion 2 % by wt. | % by vol. |
|---|---|---|---|---|
| Stearic acid | 5.00 | | 1.00 | |
| Cetyl alcohol | 5.50 | | | |
| Cetearyl alcohol | | | 2.00 | |
| PEG-40 stearate | 8.50 | | | |
| PEG-20 stearate | | | 1.00 | |
| Caprylic/capric triglyceride | 4.00 | | 2.00 | |
| $C_{12-15}$-Alkyl benzoate | 10.00 | | 15.00 | |
| Cyclomethicone | 4.00 | | | |
| Dimethicone | | | 0.50 | |
| P18 | 5.0 | | 10.0 | |
| Ethylhexyl isostearate | | | 5.00 | |
| Myristyl myristate | | | 2.00 | |
| Ceresin | 1.50 | | | |
| Glycerol | | | 3.00 | |
| Hydroxypropyl starch phosphate | 1.00 | | 3.50 | |
| BHT | | | 0.02 | |
| Disodium EDTA | 0.50 | | 0.10 | |
| Perfume oil, preservative | q.s. | | q.s. | |
| Colorant | q.s. | | q.s. | |
| Potassium hydroxide | q.s. | | q.s. | |
| Aqua dem. | ad 100 | | ad 100 | |
|  | Adjust pH to 6.5-7.5 | | Adjust pH to 5.0-6.0 | |

-continued

|  | Emulsion 1 % by wt. | % by vol. | Emulsion 2 % by wt. | % by vol. |
|---|---|---|---|---|
| Emulsion 1 |  | 70 |  |  |
| Emulsion 2 |  |  |  | 35 |
| Nitrogen |  | 30 |  |  |
| Propane/butane |  |  |  | 65 |

(5) Conditioner-Shampoo with Pearlescence

|  | 1 | 2 | 3 |
|---|---|---|---|
| Polyquaternium-10 | 0.50 | 0.50 | 0.40 |
| Sodium laureth sulfate | 9.00 | 8.50 | 8.90 |
| Cocamidopropylbetaine | 2.50 | 2.60 | 3.00 |
| Uvinul ® MS 40 | 1.50 | 0.50 | 1.00 |
| P18 | 1.0 | 5.0 | 0.5 |
| Pearlescence solution | 2.00 | 2.50 |  |
| Disodium EDTA | 0.10 | 0.15 | 0.05 |
| Preservative, perfume oil, thickener | q.s. | q.s. | q.s. |
| Aqua dem. | ad 100 | ad 100 | ad 100 |

Adjust pH to 6.0

(6) Clear conditioner-shampoo

|  | 1 | 2 | 3 |
|---|---|---|---|
| Polyquaternium-10 | 0.50 | 0.50 | 0.50 |
| Sodium laureth sulfate | 9.00 | 8.50 | 9.50 |
| P18 | 5.0 | 0.1 | 3.0 |
| Uvinul M ® 40 | 1.00 | 1.50 | 0.50 |
| Preservative, perfume oil, thickener | q.s. | q.s. | q.s. |
| Aqua dem. | ad 100 | ad 100 | ad 100 |

Adjust pH to 6.0

(7) Clear Conditioner-Shampoo with Volume Effect

|  | 1 | 2 | 3 |
|---|---|---|---|
| Sodium laureth sulfate | 10.00 | 10.50 | 11.00 |
| Uvinul ® MC 80 | 2.00 | 1.50 | 2.30 |
| P18 | 10.0 | 0.1 | 0.5 |
| Cocamidopropylbetaine | 2.50 | 2.60 | 2.20 |
| Disodium EDTA | 0.01 | 0.10 | 0.01 |
| Preservative, perfume oil, thickener | q.s. | q.s. | q.s. |
| Aqua dem. | ad 100 | ad 100 | ad 100 |

Adjust pH to 6.0

(8) Gel Cream

|  | 1 | 2 | 3 | 4 |
|---|---|---|---|---|
| Acrylates/$C_{10-30}$-alkyl acrylate crosspolymer | 0.40 | 0.35 | 0.40 | 0.35 |
| Carbomer | 0.20 | 0.22 | 0.20 | 0.22 |
| Xanthan gum | 0.10 | 0.13 | 0.10 | 0.13 |
| Cetearyl alcohol | 3.00 | 2.50 | 3.00 | 2.50 |
| $C_{12-15}$-Alkyl benzoate | 4.00 | 4.50 | 4.00 | 4.50 |
| Caprylic/capric triglyceride | 3.00 | 3.50 | 3.00 | 3.50 |
| Uvinul ® A Plus ™ | 2.00 | 1.50 | 0.75 | 1.00 |
| UvaSorb ® k2A |  | 3.00 |  |  |
| Ethylhexylbis-isopentylbenzoxazolylphenylmelamine |  |  |  |  |
| Uvinul ® MC 80 | 3.00 |  | 1.00 |  |
| Bis-Ethylhexyloxyphenol methoxyphenyltriazine |  | 1.50 |  | 2.00 |
| Butylmethoxydibenzoylmethane |  |  | 2.00 |  |
| Disodium phenyldibenzimidazoletetrasulfonate | 2.50 |  | 0.50 | 2.00 |
| Uvinul ® T 150 | 4.00 |  | 3.00 | 4.00 |
| Octocrylene |  | 4.00 |  |  |
| Diethylhexylbutamidotriazone | 1.00 |  |  | 2.00 |
| Phenylbenzimidazolesulfonic acid | 0.50 |  | 3.00 |  |
| Methylenebis-benzotriazolyltetramethylbutylphenol | 2.00 |  | 0.50 | 1.50 |
| Ethylhexyl salicylate |  |  | 3.00 |  |
| Drometrizole trisiloxane |  |  | 0.50 |  |
| Terephthalidenedicamphorsulfonic acid |  | 1.50 |  | 1.00 |
| Diethylhexyl 2,6-naphthalate | 3.50 | 4.00 | 7.00 | 9.00 |
| Titanium dioxide-microfine | 1.00 |  | 3.00 |  |
| Zinc oxide-microfine |  |  |  | 0.25 |
| P18 | 0.1 | .5 | 1.0 | 0.02 |
| Cyclomethicone | 5.00 | 5.50 | 5.00 | 5.50 |
| Dimethicone | 1.00 | 0.60 | 1.00 | 0.60 |
| Glycerol | 1.00 | 1.20 | 1.00 | 1.20 |
| Sodium hydroxide | q.s. | q.s. | q.s. | q.s. |
| Preservative | 0.30 | 0.23 | 0.30 | 0.23 |
| Perfume oil | 0.20 |  | 0.20 |  |
| Aqua dem. | ad 100 | ad 100 | ad 100 | ad 100 |

Adjust pH to 6.0

(9) OW Sunscreen Formulation

|  | 1 | 2 | 3 | 4 | 5 | 6 | 7 |
|---|---|---|---|---|---|---|---|
| Glyceryl stearate SE | 0.50 | 1.00 | 3.00 |  |  | 1.50 |  |
| Glyceryl stearate citrate | 2.00 |  | 1.00 | 2.00 | 4.00 |  |  |
| Stearic acid |  | 3.00 |  | 2.00 |  |  |  |
| PEG-40 stearate | 0.50 |  |  |  |  | 2.00 |  |

-continued

|  | 1 | 2 | 3 | 4 | 5 | 6 | 7 |
|---|---|---|---|---|---|---|---|
| Cetyl phosphate |  |  |  |  |  | 1.00 |  |
| Sodium cetearyl sulfate |  |  |  |  |  |  | 0.75 |
| Stearyl alcohol |  |  | 3.00 |  |  | 2.00 | 0.60 |
| Cetyl alcohol | 2.50 | 1.10 |  | 1.50 | 0.60 |  | 2.00 |
| P18 | 10.0 | 0.5 | 3.0 | 5.0 | 0.1 | 0.02 | 7.5 |
| Uvinul ® A Plus ™ | 2.00 | 1.50 | 0.75 | 1.00 | 2.10 | 4.50 | 5.00 |
| UvaSorb ® k2A Ethylhexylbisisopentyl-benzoxazolylphenylmelamine |  |  |  |  |  |  |  |
| Ethylhexyl methoxycinnamate Uvinul ® MC 80 |  |  |  |  | 5.00 | 6.00 | 8.00 |
| Bisethylhexyloxyphenol methoxyphenyltriazine |  | 1.50 |  | 2.00 | 2.50 |  | 2.50 |
| Butylmethoxydibenzoylmethane |  |  | 2.00 |  | 2.00 | 1.50 |  |
| Disodium phenyldibenzimidazole-tetrasulfonate | 2.50 |  | 0.50 | 2.00 |  | 0.30 |  |
| Ethylhexyl Triazone Uvinul ® T 150 | 4.00 |  | 3.00 | 4.00 |  | 2.00 |  |
| Octocrylene |  | 4.00 |  |  |  |  | 7.50 |
| Diethylhexylbutamidotriazone | 1.00 |  |  | 2.00 | 1.00 |  | 1.00 |
| Phenylbenzimidazolesulfonic acid | 0.50 |  | 3.00 |  |  |  |  |
| Methylenebis-benzotriazolyltetramethylbutyl-phenol | 2.00 |  | 0.50 | 1.50 | 2.50 |  |  |
| Ethylhexyl salicylate |  |  | 3.00 |  |  |  | 5.00 |
| Drometrizole trisiloxane |  |  | 0.50 |  |  | 1.00 |  |
| Terephthalidenedicamphor-sulfonic acid |  | 1.50 |  | 1.00 | 1.00 |  | 0.50 |
| Diethylhexyl 2,6-naphthalate | 3.50 |  | 7.00 |  | 6.00 | 9.00 |  |
| Titanium dioxide-microfine | 1.00 |  | 3.00 |  | 3.50 |  | 1.50 |
| Zinc oxide-microfine |  |  |  | 0.25 |  | 2.00 |  |
| $C_{12-15}$-Alkyl benzoate |  | 0.25 |  |  | 4.00 | 7.00 |  |
| Dicapryl ether |  |  | 3.50 |  | 2.00 |  |  |
| Butylene glycol dicaprylate/dicaprate | 5.00 |  | 6.00 |  |  |  |  |
| Cocoglyceride |  |  | 6.00 |  | 2.00 |  |  |
| Dimethicone | 0.50 |  | 1.00 |  | 2.00 |  |  |
| Cyclomethicone | 2.00 |  | 0.50 |  | 0.50 |  |  |
| *Butyrospermum parkii* (shea butter) |  | 2.00 |  |  |  |  |  |
| VP/hexadecene copolymer | 0.20 |  |  | 0.50 |  | 1.00 |  |
| Glycerol | 3.00 | 7.50 |  | 7.50 | 5.00 |  | 2.50 |
| Xanthan gum | 0.15 |  | 0.05 |  |  | 0.30 |  |
| Sodium carbomer |  | 0.20 |  | 0.15 | 0.25 |  |  |
| Vitamin E acetate | 0.60 |  | 0.23 |  | 0.70 | 1.00 |  |
| Biosaccharide gum-1 |  | 3.00 | 10.00 |  |  |  |  |
| *Glycine soya* (soybean) oil |  |  |  | 0.50 |  | 1.50 | 1.00 |
| Ethylhexylglycerol | 0.30 |  |  |  |  |  |  |
| DMDM hydantoin |  | 0.60 | 0.40 | 0.20 |  |  |  |
| Iodopropynyl butylcarbamate |  |  |  | 0.18 | 0.20 |  |  |
| Methyl paraben | 0.15 |  | 0.25 |  | 0.50 |  |  |
| Phenoxyethanol | 1.00 | 0.40 |  |  | 0.40 | 0.50 | 0.40 |
| Trisodium EDTA | 0.02 |  | 0.05 |  |  |  |  |
| Tetrasodium iminodisuccinate |  |  |  | 0.25 | 1.00 |  |  |
| Ethanol | 2.00 | 1.50 |  | 3.00 |  | 1.20 | 5.00 |
| Perfume oil | 0.10 | 0.25 | 0.30 |  | 0.40 | 0.20 |  |
| Aqua dem. | ad 100 | ad 100 | ad 100 | ad 100 | ad 100 | ad 100 | ad 100 |

(10) Hydrodispersion

|  | 1 | 2 | 3 | 4 | 5 |
|---|---|---|---|---|---|
| Ceteareth-20 | 1.00 |  |  | 0.50 |  |
| Cetyl alcohol |  |  | 1.00 |  |  |
| Sodium carbomer |  | 0.20 |  | 0.30 |  |
| Acrylates/$C_{10-30}$-alkyl acrylate crosspolymer | 0.50 |  | 0.40 | 0.10 | 0.50 |
| Xanthan gum |  | 0.30 | 0.15 |  |  |
| P18 | 5.0 | 0.5 | 3.0 | 0.1 | 10.0 |
| Uvinul ® A Plus ™ | 2.00 | 1.50 | 0.75 | 1.00 | 2.10 |
| UvaSorb ® k2A ethylhexylbis-isopentylbenzoxazolylphenylmelamine |  | 3.50 |  |  |  |

|  | 1 | 2 | 3 | 4 | 5 |
|---|---|---|---|---|---|
| Ethylhexyl methoxycinnamate Uvinul ® MC 80 |  |  |  |  | 5.00 |
| Bisethylhexyloxyphenol methoxyphenyltriazine |  | 1.50 |  | 2.00 | 2.50 |
| Butylmethoxydibenzoylmethane |  |  | 2.00 |  | 2.00 |
| Disodium phenyldibenzimidazoletetrasulfonate | 2.50 |  | 0.50 | 2.00 |  |
| Ethylhexyltriazone Uvinul ® T 150 | 4.00 |  | 3.00 | 4.00 |  |
| Octocrylene |  | 4.00 |  |  |  |
| Diethylhexylbutamidotriazone | 1.00 |  |  | 2.00 | 1.00 |
| Phenylbenzimidazolesulfonic acid | 0.50 |  | 3.00 |  |  |
| Methylenebis-benzotriazolyltetramethylbutylphenol | 2.00 |  | 0.50 | 1.50 | 2.50 |
| Ethylhexyl salicylate |  |  | 3.00 |  |  |
| Drometrizole trisiloxane |  |  | 0.50 |  |  |
| Terephthalidenedicamphorsulfonic acid |  | 1.50 |  | 1.00 | 1.00 |
| Diethylhexyl 2,6-naphthalate |  |  | 7.00 |  | 9.00 |
| Titanium dioxide-microfine | 1.00 |  | 3.00 |  | 3.50 |
| Zinc oxide-microfine |  |  |  | 0.25 |  |
| $C_{12-15}$-Alkyl benzoate | 2.00 | 2.50 |  |  |  |
| Dicapryl ether |  | 4.00 |  |  |  |
| Butylene glycol dicaprylate/dicaprate | 4.00 |  | 2.00 | 6.00 |  |
| Dicapryl carbonate |  | 2.00 | 6.00 |  |  |
| Dimethicone |  | 0.50 | 1.00 |  |  |
| Phenyltrimethicone | 2.00 |  | 0.50 |  |  |
| *Butyrospermum parkii* (shea butter) |  | 2.00 |  | 5.00 |  |
| VP/hexadecene copolymer | 0.50 |  |  | 0.50 | 1.00 |
| Tricontanyl-PVP | 0.50 |  | 1.00 |  |  |
| Ethylhexylglycerol |  |  | 1.00 |  | 0.80 |
| Glycerol | 3.00 | 7.50 |  | 7.50 | 8.50 |
| *Glycine soya* (soybean) oil |  |  | 1.50 |  | 1.00 |
| Vitamin E acetate | 0.50 |  | 0.25 |  | 1.00 |
| Glucosylrutin | 0.60 |  |  | 0.25 |  |
| Biosaccharide gum-1 |  | 2.50 | 0.50 |  | 2.00 |
| DMDM hydantoin |  | 0.60 | 0.45 | 0.25 |  |
| Iodopropynyl butylcarbamate | 0.20 |  |  |  |  |
| Methyl paraben | 0.50 |  | 0.25 | 0.15 |  |
| Phenoxyethanol | 0.50 | 0.40 |  | 1.00 |  |
| Trisodium EDTA |  | 0.01 | 0.05 |  | 0.10 |
| Ethanol | 3.00 | 2.00 | 1.50 |  | 7.00 |
| Perfume oil | 0.20 |  | 0.05 | 0.40 |  |
| Aqua dem. | ad 100 | ad 100 | ad 100 | ad 100 | ad 100 |

(11) WO Sunscreen Emulsion

|  | 1 | 2 | 3 | 4 | 5 |
|---|---|---|---|---|---|
| Cetyldimethicone |  | 2.50 |  | 4.00 |  |
| Polyglyceryl-2 dipolyhydroxystearate | 5.00 |  |  |  | 4.50 |
| PEG-30 dipolyhydroxystearate |  |  | 5.00 |  |  |
| P18 | 5.0 | 1.0 | 10.0 | 0.5 | 0.1 |
| Uvinul ® A Plus ™ | 2.00 | 1.50 | 0.75 | 1.00 | 2.10 |
| UvaSorb ® k2A |  | 2.00 |  |  |  |
| Ethylhexylbis-isopentylbenzoxazolylphenylmelamine |  |  |  |  |  |
| Ethylhexyl methoxycinnamate Uvinul ® MC 80 |  |  |  |  | 5.00 |
| Bisethylhexyloxyphenol methoxyphenyl-triazine |  | 1.50 |  | 2.00 | 2.50 |
| Butylmethoxydibenzoylmethane |  |  | 2.00 |  | 2.00 |
| Disodium phenyldibenzimidazoletetrasulfonate | 2.50 |  | 0.50 | 2.00 |  |
| Ethylhexyltriazone Uvinul ® T 150 | 4.00 |  | 3.00 | 4.00 |  |
| Octocrylene |  | 4.00 |  |  |  |
| Diethylhexylbutamidotriazone | 1.00 |  |  | 2.00 | 1.00 |
| Phenylbenzimidazolesulfonic acid | 0.50 |  | 3.00 |  |  |
| Methylenebisbenzotriazolyltetra-methylbutylphenol | 2.00 |  | 0.50 | 1.50 | 2.50 |
| Ethylhexyl salicylate |  |  | 3.00 |  |  |
| Drometrizole trisiloxane |  |  | 0.50 |  |  |
| Terephthalidenedicamphorsulfonic acid |  | 1.50 |  | 1.00 | 1.00 |
| Diethylhexyl 2,6-naphthalate |  |  | 7.00 |  | 4.00 |
| Titanium dioxide-microfine | 1.00 |  | 3.00 |  | 3.50 |
| Zinc oxide-microfine |  |  |  | 0.25 |  |

-continued

|  | 1 | 2 | 3 | 4 | 5 |
|---|---|---|---|---|---|
| Mineral oil |  | 12.00 | 10.00 |  | 8.00 |
| $C_{12-15}$-Alkyl benzoate |  |  |  | 9.00 |  |
| Dicaprylyl ether | 10.00 |  |  |  | 7.00 |
| Butylene glycol dicaprylate/dicaprate |  |  | 2.00 | 8.00 | 4.00 |
| Dicaprylyl carbonate | 5.00 |  | 6.00 |  |  |
| Dimethicone |  | 4.00 | 1.00 | 5.00 |  |
| Cyclomethicone | 2.00 | 25.00 |  |  | 2.00 |
| *Butyrospermum parkii* (shea butter) |  |  | 3.00 |  |  |
| Petrolatum |  | 4.50 |  |  |  |
| VP/hexadecene copolymer | 0.50 |  |  | 0.50 | 1.00 |
| Ethylhexylglycerol |  | 0.30 | 1.00 |  | 0.50 |
| Glycerol | 3.00 | 7.50 |  | 7.50 | 8.50 |
| *Glycine soya* (soybean) oil |  | 1.00 | 1.50 |  | 1.00 |
| Magnesium sulfate $MgSO_4$ | 1.00 | 0.50 |  | 0.50 |  |
| Magnesium chloride $MgCl_2$ |  |  | 1.00 |  | 0.70 |
| Vitamin E acetate | 0.50 |  | 0.25 |  | 1.00 |
| Ascorbyl palmitate | 0.50 |  |  | 2.00 |  |
| Biosaccharide gum-1 |  |  |  | 3.50 | 1.00 |
| DMDM hydantoin |  | 0.60 | 0.40 | 0.20 |  |
| Methyl paraben | 0.50 |  | 0.25 | 0.15 |  |
| Phenoxyethanol | 0.50 | 0.40 |  | 1.00 |  |
| Trisodium EDTA | 0.12 | 0.05 |  | 0.30 |  |
| Ethanol | 3.00 |  | 1.50 |  | 5.00 |
| Perfume oil | 0.20 |  | 0.40 | 0.35 |  |
| Aqua dem. | ad 100 | ad 100 | ad 100 | ad 100 | ad 100 |

(12) Sticks

|  | 1 | 2 | 3 | 4 |
|---|---|---|---|---|
| Caprylic/capric triglyceride | 12.00 | 10.00 | 6.00 |  |
| Octyldodecanol | 7.00 | 14.00 | 8.00 | 3.00 |
| Butylene glycol dicaprylate/dicaprate |  |  |  | 12.00 |
| Pentaerythrityl tetraisostearate | 10.00 | 6.00 | 8.00 | 7.00 |
| Polyglyceryl-3 diisostearate | 2.50 |  |  |  |
| Bisdiglyceryl polyacyladipate-2 | 9.00 | 8.00 | 10.00 | 8.00 |
| Cetearyl alcohol | 8.00 | 11.00 | 9.00 | 7.00 |
| Myristyl myristate | 3.50 | 3.00 | 4.00 | 3.00 |
| Beeswax | 5.00 | 5.00 | 6.00 | 6.00 |
| *Copernicia cerifera* (carnauba) wax | 1.50 | 2.00 | 2.00 | 1.50 |
| Cera alba | 0.50 | 0.50 | 0.50 | 0.40 |
| $C_{16-40}$ Alkyl stearate |  | 1.50 | 1.50 | 1.50 |
| P18 | 0.5 | 3.0 | 1.0 | 5.0 |
| Uvinul ® A Plus ™ | 2.00 | 1.50 | 0.75 | 9.00 |
| UvaSorb ® k2A |  | 2.00 |  | 4.00 |
| Ethylhexylbis-isopentylbenzoxazolylphenyl-melamine |  |  |  |  |
| Ethylhexyl methoxycinnamate Uvinul ® MC 80 |  | 3.00 |  |  |
| Bis-Ethylhexyloxyphenol methoxyphenyltriazine |  | 1.50 |  | 2.00 |

-continued

|  | 1 | 2 | 3 | 4 |
|---|---|---|---|---|
| Butylmethoxydibenzoylmethane |  |  | 2.00 |  |
| Disodium phenyldibenzimidazole-tetrasulfonate | 2.50 |  | 0.50 | 2.00 |
| Ethylhexyltriazone Uvinul ® T 150 | 4.00 |  | 3.00 | 4.00 |
| Octocrylene |  | 4.00 |  |  |
| Diethylhexylbutamidotriazone | 1.00 |  |  | 2.00 |
| Phenylbenzimidazolesulfonic acid | 0.50 |  | 3.00 |  |
| Methylenebis-benzotriazolyltetramethyl-butylphenol | 2.00 |  | 0.50 | 1.50 |
| Ethylhexyl salicylate |  |  | 3.00 |  |
| Drometrizole trisiloxane |  |  | 0.50 |  |
| Terephthalidenedicamphorsulfonic acid |  | 1.50 |  | 1.00 |
| Diethylhexyl 2,6-naphthalate |  |  | 7.00 |  |
| Titanium dioxide-microfine | 1.00 |  | 3.00 |  |
| Zinc oxide-microfine |  |  |  | 0.25 |
| Vitamin E acetate | 0.50 | 1.00 |  |  |
| Ascorbyl palmitate | 0.05 |  | 0.05 |  |
| *Buxux chinensis* (jojoba) oil | 2.00 | 1.00 |  | 1.00 |
| Perfume oil, BHT | 0.10 | 0.25 |  | 0.35 |
| *Ricinus communis* (castor) oil | ad 100 | ad 100 | ad 100 | ad 100 |

(13) PIT Emulsion

|  | 1 | 2 | 3 | 4 | 5 | 6 | 7 | 8 |
|---|---|---|---|---|---|---|---|---|
| Glyceryl monostearate SE | 0.50 | 2.00 | 3.00 | 5.00 |  | 0.50 | 4.00 |  |
| Glyceryl isostearate |  |  |  |  | 3.50 | 4.00 | 2.00 |  |
| Isoceteth-20 |  |  | 0.50 |  | 2.00 |  |  |  |
| Ceteareth-12 |  |  | 5.00 | 1.00 |  |  | 3.50 | 5.00 |
| Ceteareth-20 |  |  | 5.00 | 1.00 |  |  |  | 3.50 |
| PEG-100 stearate |  |  |  | 2.80 |  | 2.30 | 3.30 |  |
| Cetyl alcohol | 5.20 |  | 1.20 | 1.00 | 1.30 |  | 0.50 | 0.30 |
| Cetyl palmitate | 2.50 | 1.20 |  | 1.50 |  | 0.50 |  | 1.50 |
| Cetyldimethicone copolyol |  |  |  | 0.50 |  | 1.00 |  |  |
| Polyglyceryl-2 dioleate |  |  |  | 0.75 | 0.30 |  |  |  |
| P18 | 0.1 | 5.0 | 0.01 | 0.5 | 3.0 | 0.25 | 10.0 | 3.0 |
| Uvinul ® A Plus ™ | 2.00 | 1.50 | 0.75 | 1.00 | 2.10 | 4.50 | 5.00 | 2.10 |

|  | 1 | 2 | 3 | 4 | 5 | 6 | 7 | 8 |
|---|---|---|---|---|---|---|---|---|
| UvaSorb ® k2A Ethylhexylbisisopentylbenzoxazolylphenylmelamine |  |  | 4.00 |  |  |  | 1.50 |  |
| Ethylhexyl methoxycinnamate Uvinul ® MC 80 |  |  |  |  | 5.00 | 6.00 | 8.00 | 5.00 |
| Bisethylhexyloxyphenol methoxyphenyltriazine |  | 1.50 |  | 2.00 | 2.50 |  | 2.50 | 2.50 |
| Butylmethoxydibenzoylmethane |  |  | 2.00 |  | 2.00 | 1.50 |  | 2.00 |
| Disodium phenyldibenzimidazoletetrasulfonate | 2.50 |  | 0.50 | 2.00 |  | 0.30 |  |  |
| Ethylhexyltriazone Uvinul ® T 150 | 4.00 |  |  | 3.00 | 4.00 |  | 2.00 |  |
| Octocrylene |  | 4.00 |  |  |  |  | 7.50 |  |
| Diethylhexylbutamidotriazone | 1.00 |  |  | 2.00 | 1.00 |  | 1.00 | 1.00 |
| Phenylbenzimidazole sulfonic acid | 0.50 |  | 3.00 |  |  |  |  |  |
| Methylenebis-benzotriazolyltetramethylbutylphenol | 2.00 |  | 0.50 | 1.50 | 2.50 |  |  | 2.50 |
| Ethylhexyl salicylate |  |  | 3.00 |  |  |  | 5.00 |  |
| Drometrizole trisiloxane |  |  | 0.50 |  |  | 1.00 |  |  |
| Terephthalidene-dicamphorsulfonic acid |  | 1.50 |  | 1.00 | 1.00 |  | 0.50 | 1.00 |
| Diethylhexyl 2,6-naphthalate |  |  | 7.00 |  | 10.00 | 7.50 |  | 8.00 |
| Titanium dioxide-microfine | 1.00 |  | 3.00 |  | 3.50 |  | 1.50 | 3.50 |
| Zinc oxide-microfine |  |  |  | 0.25 |  | 2.00 |  |  |
| $C_{12-15}$-Alkyl benzoate | 3.50 |  |  | 6.35 |  |  |  | 0.10 |
| Cocoglyceride |  | 3.00 |  | 3.00 |  |  |  | 1.00 |
| Dicapryl ether | 4.50 |  |  |  |  |  |  |  |
| Dicaprylyl carbonate |  | 4.30 |  | 3.00 |  |  |  | 7.00 |
| Dibutyl adipate |  |  |  | 0.50 |  |  |  | 0.30 |
| Phenyltrimethicone | 2.00 |  |  | 3.50 |  | 2.00 |  |  |
| Cyclomethicone |  | 3.00 |  |  |  |  |  |  |
| $C_{1-5}$ Alkylgalactomannan |  | 0.50 |  |  | 2.00 |  |  |  |
| Hydrogenated cocoglyceride |  |  |  |  | 3.00 | 4.00 |  |  |
| Behenoxy-dimethicone |  |  |  |  |  |  | 1.50 | 2.00 |
| VP/hexadecene copolymer |  |  |  | 1.00 | 1.20 |  |  |  |
| Glycerol | 4.00 | 6.00 | 5.00 |  | 8.00 | 10.00 |  |  |
| Vitamin E acetate | 0.20 | 0.30 | 0.40 |  | 0.30 |  |  |  |
| *Butyrospermum parkii* (shea butter) |  | 2.00 |  | 3.60 |  | 2.00 |  |  |
| Iodopropyl butylcarbamate | 0.12 |  |  |  | 0.20 |  |  |  |
| Biosaccharide gum-1 |  |  |  | 0.10 |  |  |  |  |
| DMDM hydantoin | 0.10 |  |  |  | 0.12 |  | 0.13 |  |
| Methyl paraben |  | 0.50 | 0.30 |  | 0.35 |  |  |  |
| Phenoxyethanol | 0.50 | 0.40 |  | 1.00 |  |  |  |  |
| Ethylhexylglycerol |  | 0.30 |  |  | 1.00 |  | 0.35 |  |
| Ethanol | 2.00 |  | 2.00 |  |  | 5.00 |  |  |
| Trisodium EDTA | 0.40 |  | 0.15 |  |  | 0.20 |  |  |
| Perfume oil | 0.20 |  | 0.20 |  | 0.24 | 0.16 | 0.10 | 0.10 |
| Aqua dem. | ad 100 | ad 100 | ad 100 | ad 100 | ad 100 | ad 100 | ad 100 | ad 100 |

(14) Gel Cream

|  | 1 | 2 | 3 | 4 |
|---|---|---|---|---|
| Acrylates/$C_{10-30}$-alkyl acrylate crosspolymer | 0.40 | 0.35 | 0.40 | 0.35 |
| Carbomer | 0.20 | 0.22 | 0.20 | 0.22 |
| Luvigel ® EM | 1.50 | 2.50 | 2.80 | 3.50 |
| Xanthan gum | 0.10 | 0.13 | 0.10 | 0.13 |
| Cetearyl alcohol | 3.00 | 2.50 | 3.00 | 2.50 |
| $C_{12-15}$-Alkyl benzoate | 4.00 | 4.50 | 4.00 | 4.50 |
| Caprylic/capric triglyceride | 3.00 | 3.50 | 3.00 | 3.50 |
| Titanium dioxide-microfine | 1.00 |  | 1.50 |  |

187 -continued

|                       | 1    | 2    | 3    | 4    |
|-----------------------|------|------|------|------|
| Zinc oxide-microfine  |      | 2.00 |      | 0.25 |
| P18                   | 0.5  | 10.0 | 3.0  | 5.0  |
| Dihydroxyacetone      |      |      | 3.00 | 5.00 |
| Cyclomethicone        | 5.00 | 5.50 | 5.00 | 5.50 |
| Dimethicone           | 1.00 | 0.60 | 1.00 | 0.60 |
| Glycerol              | 1.00 | 1.20 | 1.00 | 1.20 |
| Sodium hydroxide      | q.s. | q.s. | q.s. | q.s. |

188 -continued

|              | 1      | 2      | 3      | 4      |
|--------------|--------|--------|--------|--------|
| Preservative | 0.30   | 0.23   | 0.30   | 0.23   |
| Perfume oil  | 0.20   |        | 0.20   |        |
| Aqua dem.    | ad 100 | ad 100 | ad 100 | ad 100 |

Adjust pH to 6.0

(15) OW Self-Tanning Formulations

|                                      | 1      | 2      | 3      | 4      | 5      | 6      | 7      |
|--------------------------------------|--------|--------|--------|--------|--------|--------|--------|
| Glyceryl monostearate SE             | 0.50   | 1.00   | 3.00   |        |        | 1.50   |        |
| Glyceryl stearate citrate            | 2.00   |        | 1.00   | 2.00   | 4.00   |        |        |
| Stearic acid                         |        | 3.00   |        | 2.00   |        |        |        |
| PEG-40 stearate                      | 0.50   |        |        |        |        | 2.00   |        |
| Cetyl phosphate                      |        |        |        |        |        | 1.00   |        |
| Cetearyl sulfate                     |        |        |        |        |        |        | 0.75   |
| Stearyl alcohol                      |        |        | 3.00   |        |        | 2.00   | 0.60   |
| Cetyl alcohol                        | 2.50   | 1.10   |        | 1.50   | 0.60   |        | 2.00   |
| P18                                  | 0.1    | 0.5    | 0.025  | 5.0    | 3.0    | 10.0   | 1.0    |
| Dihydroxyacetone                     |        |        | 3.00   | 5.00   |        | 4      |        |
| Titanium dioxide-microfine           | 1.00   |        |        |        | 1.50   |        | 1.50   |
| Zinc oxide-microfine                 |        |        |        | 0.25   |        | 2.00   |        |
| $C_{12-15}$-Alkyl benzoate           |        | 0.25   |        |        | 4.00   | 7.00   |        |
| Dicapryl ether                       |        |        |        | 3.50   | 2.00   |        |        |
| Butylene glycol dicaprylate/dicaprate| 5.00   |        |        | 6.00   |        |        |        |
| Cocoglyceride                        |        |        | 6.00   |        | 2.00   |        |        |
| Dimethicone                          | 0.50   |        | 1.00   |        | 2.00   |        |        |
| Cyclomethicone                       | 2.00   |        | 0.50   |        | 0.50   |        |        |
| *Butyrospermum parkii* (shea butter) |        | 2.00   |        |        |        |        |        |
| VP/hexadecene copolymer              | 0.20   |        |        | 0.50   |        | 1.00   |        |
| Glycerol                             | 3.00   | 7.50   |        | 7.50   | 5.00   |        | 2.50   |
| Xanthan gum                          | 0.15   |        | 0.05   |        |        | 0.30   |        |
| Sodium carbomer                      |        | 0.20   |        | 0.15   | 0.25   |        |        |
| Vitamin E acetate                    | 0.60   |        | 0.23   |        | 0.70   | 1.00   |        |
| Biosaccharide gum-1                  |        | 3.00   | 10.00  |        |        |        |        |
| *Glycine soya* (soybean) oil         |        |        |        | 0.50   |        | 1.50   | 1.00   |
| Ethylhexylglycerol                   | 0.30   |        |        |        |        |        |        |
| DMDM hydantoin                       |        | 0.60   | 0.40   | 0.20   |        |        |        |
| Iodopropynyl butylcarbamate          |        |        |        | 0.18   | 0.20   |        |        |
| Methyl paraben                       | 0.15   |        | 0.25   |        | 0.50   |        |        |
| Phenoxyethanol                       | 1.00   | 0.40   |        |        | 0.40   | 0.50   | 0.40   |
| Trisodium EDTA                       | 0.02   |        | 0.05   |        |        |        |        |
| Tetrasodium iminodisuccinate         |        |        |        | 0.25   | 1.00   |        |        |
| Ethanol                              | 2.00   | 1.50   |        | 3.00   |        | 1.20   | 5.00   |
| Perfume oil                          | 0.10   | 0.25   | 0.30   |        | 0.40   | 0.20   |        |
| Aqua dem.                            | ad 100 | ad 100 | ad 100 | ad 100 | ad 100 | ad 100 | ad 100 |

(16) OW Make-Up

|                                      | 1      | 2      | 3      | 4      | 5      | 6      | 7      |
|--------------------------------------|--------|--------|--------|--------|--------|--------|--------|
| Glyceryl monostearate SE             | 0.50   | 1.00   | 3.00   |        |        | 1.50   |        |
| Glyceryl stearate citrate            | 2.00   |        | 1.00   | 2.00   | 4.00   |        |        |
| Stearic acid                         |        | 3.00   |        | 2.00   |        |        |        |
| PEG-40 stearate                      | 0.50   |        |        |        |        | 2.00   |        |
| Cetyl phosphate                      |        |        |        |        |        | 1.00   |        |
| Cetearyl sulfate                     |        |        |        |        |        |        | 0.75   |
| Stearyl alcohol                      |        |        | 3.00   |        |        | 2.00   | 0.60   |
| Cetyl alcohol                        | 2.50   | 1.10   |        | 1.50   | 0.60   |        | 2.00   |
| P18                                  | 3.0    | 5.0    | 2.0    | 0.5    | 1.0    | 5.0    | 10.0   |
| Titanium dioxide                     | 10.00  | 12.00  | 9.00   | 8.50   | 11.00  | 9.50   | 10.00  |
| Iron oxide                           | 2.00   | 4.00   | 3.00   | 5.00   | 3.40   | 6.00   | 4.40   |
| Zinc oxide                           |        | 4.00   |        | 2.00   |        | 3.00   |        |
| $C_{12-15}$-Alkyl benzoate           |        | 0.25   |        |        | 4.00   | 7.00   |        |
| Dicapryl ether                       |        |        |        | 3.50   | 2.00   |        |        |
| Butylene glycol dicaprylate/dicaprate| 5.00   |        |        | 6.00   |        |        |        |
| Cocoglyceride                        |        |        | 6.00   |        | 2.00   |        |        |

-continued

|  | 1 | 2 | 3 | 4 | 5 | 6 | 7 |
|---|---|---|---|---|---|---|---|
| Dimethicone | 0.50 |  | 1.00 |  | 2.00 |  |  |
| Cyclomethicone | 2.00 |  | 0.50 |  | 0.50 |  |  |
| *Butyrospermum parkii* (shea butter) |  | 2.00 |  |  |  |  |  |
| VP/hexadecene copolymer | 0.20 |  |  | 0.50 |  | 1.00 |  |
| Glycerol | 3.00 | 7.50 |  | 7.50 | 5.00 |  | 2.50 |
| Xanthan gum | 0.15 |  | 0.05 |  |  | 0.30 |  |
| Sodium carbomer |  | 0.20 |  | 0.15 | 0.25 |  |  |
| Vitamin E acetate | 0.60 |  | 0.23 |  | 0.70 | 1.00 |  |
| *Glycine soya* (soybean) oil |  |  |  | 0.50 |  | 1.50 | 1.00 |
| Ethylhexylglycerol | 0.30 |  |  |  |  |  |  |
| DMDM hydantoin |  | 0.60 | 0.40 | 0.20 |  |  |  |
| Iodopropynyl butylcarbamate |  |  |  | 0.18 | 0.20 |  |  |
| Methyl paraben | 0.15 |  | 0.25 |  | 0.50 |  |  |
| Phenoxyethanol | 1.00 | 0.40 |  |  | 0.40 | 0.50 | 0.40 |
| Trisodium EDTA | 0.02 |  | 0.05 |  |  |  |  |
| Tetrasodium iminodisuccinate |  |  |  | 0.25 | 1.00 |  |  |
| Ethanol | 2.00 | 1.50 |  | 3.00 |  | 1.20 | 5.00 |
| Perfume oil | 0.10 | 0.25 | 0.30 |  | 0.40 | 0.20 |  |
| Aqua dem. | ad 100 | ad 100 | ad 100 | ad 100 | ad 100 | ad 100 | ad 100 |

(17) Self-Tannins Hydrodispersion

|  | 1 | 2 | 3 | 4 | 5 |
|---|---|---|---|---|---|
| Ceteareth-20 | 1.00 |  |  | 0.50 |  |
| Cetyl alcohol |  | 1.00 |  |  |  |
| Luvigel ® EM |  | 2.00 |  | 2.50 | 2.00 |
| Acrylates/C$_{10-30}$-alkyl acrylate crosspolymer | 0.50 |  | 0.40 | 0.10 | 0.50 |
| Xanthan gum |  | 0.30 | 0.15 |  |  |
| P18 | 3.0 | 1.0 | 0.5 | 0.1 | 5.0 |
| Dihydroxyacetone |  |  | 3.00 | 5.00 |  |
| Uvinul ® A Plus ™ | 2.00 | 1.50 | 0.75 | 1.00 | 2.10 |
| Titanium dioxide-microfine | 1.00 |  | 1.00 |  | 1.00 |
| Zinc oxide-microfine |  | 1.90 |  | 0.25 |  |
| C$_{12-15}$-Alkyl benzoate | 2.00 | 2.50 |  |  |  |
| Dicapryl ether |  | 4.00 |  |  |  |
| Butylene glycol dicaprylate/dicaprate | 4.00 |  | 2.00 | 6.00 |  |
| Dicapryl carbonate |  | 2.00 | 6.00 |  |  |
| Dimethicone |  |  | 0.50 | 1.00 |  |
| Phenyltrimethicone | 2.00 |  | 0.50 |  |  |
| *Butyrospermum parkii* (shea butter) |  | 2.00 |  | 5.00 |  |
| VP/hexadecene copolymer | 0.50 |  |  | 0.50 | 1.00 |
| Tricontanyl-PVP | 0.50 |  | 1.00 |  |  |
| Ethylhexylglycerol |  |  | 1.00 |  | 0.80 |
| Glycerol | 3.00 | 7.50 |  | 7.50 | 8.50 |
| *Glycine soya* (soybean) oil |  |  | 1.50 |  | 1.00 |
| Vitamin E acetate | 0.50 |  | 0.25 |  | 1.00 |
| Glucosylrutin | 0.60 |  |  | 0.25 |  |
| DMDM hydantoin |  | 0.60 | 0.45 | 0.25 |  |
| Iodopropynyl butylcarbamate | 0.20 |  |  |  |  |
| Methyl paraben | 0.50 |  | 0.25 | 0.15 |  |
| Phenoxyethanol | 0.50 | 0.40 |  | 1.00 |  |
| Trisodium EDTA |  | 0.01 | 0.05 |  | 0.10 |
| Ethanol | 3.00 | 2.00 | 1.50 |  | 7.00 |
| Perfume oil | 0.20 |  | 0.05 | 0.40 |  |
| Aqua dem. | ad 100 | ad 100 | ad 100 | ad 100 | ad 100 |

(18) Aftersun Hydrodispersion

|  | 1 | 2 | 3 | 4 | 5 |
|---|---|---|---|---|---|
| Ceteareth-20 | 1.00 |  |  | 0.50 |  |
| Cetyl alcohol |  |  | 1.00 |  |  |
| Luvigel ® EM |  | 2.00 |  | 2.50 | 2.00 |
| Acrylates/C$_{10-30}$-alkyl acrylate crosspolymer | 0.50 | 0.30 | 0.40 | 0.10 | 0.50 |
| Xanthan gum |  | 0.30 | 0.15 |  |  |
| P18 | 0.1 | 5.0 | 0.5 | 3.0 | 1.0 |
| C$_{12-15}$-Alkyl benzoate | 2.00 | 2.50 |  |  |  |
| Dicapryl ether |  | 4.00 |  |  |  |
| Butylene glycol dicaprylate/dicaprate | 4.00 |  |  | 2.00 | 6.00 |
| Dicapryl carbonate |  | 2.00 | 6.00 |  |  |
| Dimethicone |  |  | 0.50 | 1.00 |  |

-continued

|  | 1 | 2 | 3 | 4 | 5 |
|---|---|---|---|---|---|
| Phenyltrimethicone | 2.00 |  | 0.50 |  |  |
| Tricontanyl-PVP | 0.50 |  | 1.00 |  |  |
| Ethylhexylglycerol |  |  | 1.00 |  | 0.80 |
| Glycerol | 3.00 | 7.50 |  | 7.50 | 8.50 |
| *Glycine soya* (soybean) oil |  |  | 1.50 |  | 1.00 |
| Vitamin E acetate | 0.50 |  | 0.25 |  | 1.00 |
| Glucosylrutin | 0.60 |  |  | 0.25 |  |
| Trisodium EDTA |  | 0.01 | 0.05 |  | 0.10 |
| Ethanol | 15.00 | 10.00 | 8.00 | 12.00 | 9.00 |
| Perfume oil | 0.20 |  | 0.05 | 0.40 |  |
| Aqua dem. | ad 100 | ad 100 | ad 100 | ad 100 | ad 100 |

(19) WO Emulsions

|  | 1 | 2 | 3 | 4 | 5 |
|---|---|---|---|---|---|
| Cetyldimethicone |  | 2.50 |  | 4.00 |  |
| Polyglyceryl-2 dipolyhydroxystearate | 5.00 |  |  |  | 4.50 |
| PEG-30 dipolyhydroxystearate |  |  | 5.00 |  |  |
| P18 | 5.0 | 10.0 | 0.1 | 0.5 | 1.0 |
| Uvinul ® A Plus ™ | 2.00 | 1.50 | 0.75 | 1.00 | 2.10 |
| Titanium dioxide-microfine | 1.00 |  | 3.00 |  | 3.50 |
| Zinc oxide-microfine |  | 0.90 |  | 0.25 |  |
| Mineral oil |  | 12.00 | 10.00 |  | 8.00 |

-continued

|  | 1 | 2 | 3 | 4 | 5 |
|---|---|---|---|---|---|
| $C_{12-15}$-Alkyl benzoate |  |  |  | 9.00 |  |
| Dicaprylyl ether | 10.00 |  |  |  | 7.00 |
| Butylene glycol dicaprylate/dicaprate |  |  | 2.00 | 8.00 | 4.00 |
| Dicaprylyl carbonate | 5.00 |  | 6.00 |  |  |
| Dimethicone |  | 4.00 | 1.00 | 5.00 |  |
| Cyclomethicone | 2.00 | 25.00 |  |  | 2.00 |
| *Butyrospermum parkii* (shea butter) |  |  | 3.00 |  |  |
| Vaseline |  | 4.50 |  |  |  |
| VP/hexadecene copolymer | 0.50 |  |  | 0.50 | 1.00 |
| Ethylhexylglycerol |  | 0.30 | 1.00 |  | 0.50 |
| Glycerol | 3.00 | 7.50 |  | 7.50 | 8.50 |
| *Glycine soya* (soybean) oil |  | 1.00 | 1.50 |  | 1.00 |
| Magnesium sulfate | 1.00 | 0.50 |  | 0.50 |  |
| Magnesium chloride |  |  | 1.00 |  | 0.70 |
| Vitamin E acetate | 0.50 |  | 0.25 |  | 1.00 |
| Ascorbyl palmitate | 0.50 |  |  | 2.00 |  |
| Biosaccharide gum-1 |  |  |  | 3.50 | 7.00 |
| DMDM hydantoin |  | 0.60 | 0.40 | 0.20 |  |
| Methyl paraben | 0.50 |  | 0.25 | 0.15 |  |
| Phenoxyethanol | 0.50 | 0.40 |  |  | 1.00 |
| Trisodium EDTA | 0.12 | 0.05 |  | 0.30 |  |
| Ethanol | 3.00 |  | 1.50 |  | 5.00 |
| Perfume oil | 0.20 |  | 0.40 | 0.35 |  |
| Aqua dem. | ad 100 | ad 100 | ad 100 | ad 100 | ad 100 |

(20) Solids-Stabilized Emulsion (Pickering Emulsions)

|  | 1 | 2 | 3 | 4 | 5 |
|---|---|---|---|---|---|
| Mineral oil |  |  | 16.00 | 16.00 |  |
| Octyldodecanol | 9.00 | 9.00 | 5.00 |  |  |
| Caprylic/capric triglyceride | 9.00 | 9.00 | 6.00 |  |  |
| $C_{12-15}$-Alkyl benzoate |  |  |  | 5.00 | 8.00 |
| Butylene glycol dicaprylate/dicaprate |  |  |  |  | 8.00 |
| Dicaprylyl ether | 9.00 |  |  | 4.00 |  |
| Dicaprylyl carbonate |  | 9.00 |  |  |  |
| Hydroxyoctacosanyl hydroxystearate | 2.00 | 2.00 | 2.20 | 2.50 | 1.50 |
| Disteardimonium hectorite | 1.00 | 0.75 |  | 0.50 | 0.25 |
| Cera microcristallina + paraffinum liquidum |  |  | 0.35 |  | 5.00 |
| Hydroxypropylmethylcellulose |  |  | 0.10 |  | 0.05 |
| Dimethicone |  |  |  |  | 3.00 |
| P18 | 1.0 | 0.5 | 0.1 | 3.0 | 5.0 |
| Titanium dioxide + aluminum oxide + simethicone + aqua |  | 3.00 |  |  |  |
| Titanium dioxide + trimethoxycaprylylsilane |  | 2.00 | 4.00 | 2.00 | 4.00 |
| Silicon dimethylsilylate | 2.50 |  |  | 6.00 | 2.50 |
| Boron nitride |  |  | 1.00 |  |  |
| Starch/sodium metaphosphate polymer | 2.00 |  |  |  |  |
| Manioc starch or tapioca |  | 0.50 |  |  |  |
| Sodium chloride | 5.00 | 7.00 | 8.50 | 3.00 | 4.50 |
| Glycerol |  |  |  | 1.00 |  |
| Trisodium EDTA | 1.00 | 1.00 | 1.00 | 1.00 | 1.00 |
| Vitamin E acetate | 5.00 | 10.00 | 3.00 | 6.00 | 10.00 |
| Ascorbyl palmitate | 1.00 | 1.00 |  | 1.00 |  |
| Methyl paraben |  | 0.60 |  |  | 0.20 |
| Propyl paraben |  |  |  |  | 0.20 |
| Phenoxyethanol |  |  | 0.20 |  |  |
| Hexamidine diisethionate |  |  | 0.40 | 0.50 | 0.40 |
| Diazolidinylurea |  |  |  |  | 0.08 |
| Ethanol |  |  | 0.23 | 0.20 |  |
| Perfume oil | 5.00 |  | 3.00 | 4.00 |  |
| Aqua dem. | 0.20 |  | 0.30 | 0.10 |  |
|  | ad 100 | ad 100 | ad 100 | ad 100 | ad 100 |

(21) Sticks

|  | 1 | 2 | 3 | 4 |
|---|---|---|---|---|
| Caprylic/capric triglyceride | 12.00 | 10.00 | 6.00 | |
| Octyldodecanol | 7.00 | 14.00 | 8.00 | 3.00 |
| Butylene glycol dicaprylate/dicaprate | | | | 12.00 |
| Pentaerythrityl tetraisostearate | 10.00 | 6.00 | 8.00 | 7.00 |
| Polyglyceryl-3 diisostearate | 2.50 | | | |
| Bisdiglyceryl polyacyladipate-2 | 9.00 | 8.00 | 10.00 | 8.00 |
| Cetearyl alcohol | 8.00 | 11.00 | 9.00 | 7.00 |
| Myristyl myristate | 3.50 | 3.00 | 4.00 | 3.00 |
| Beeswax | 5.00 | 5.00 | 6.00 | 6.00 |
| *Copernicia cerifera* (carnauba) wax | 1.50 | 2.00 | 2.00 | 1.50 |
| Cera Alba | 0.50 | 0.50 | 0.50 | 0.40 |
| $C_{16-40}$-Alkyl stearate | | 1.50 | 1.50 | 1.50 |
| P18 | 10.0 | 1.0 | 3.0 | 0.1 |
| Uvinul ® A Plus ™ | 2.00 | 1.50 | 0.75 | 9.00 |
| Titanium dioxide-microfine | 1.00 | | 3.00 | |
| Zinc oxide-microfine | | 1.00 | | 0.25 |
| Vitamin E acetate | 0.50 | 1.00 | | |
| Ascorbyl palmitate | 0.05 | | 0.05 | |
| *Buxux chinensis* (jojoba) oil | 2.00 | 1.00 | | 1.00 |
| Perfume oil, BHT | 0.10 | 0.25 | | 0.35 |
| *Ricinus communis* (castor) oil | ad 100 | ad 100 | ad 100 | ad 100 |

(22) Self-Tanning PIT Emulsions

|  | 1 | 2 | 3 | 4 | 5 | 6 | 7 | 8 |
|---|---|---|---|---|---|---|---|---|
| Glyceryl monostearate SE | 0.50 | 2.00 | 3.00 | 5.00 | | 0.50 | 4.00 | |
| Glyceryl isostearate | | | | | 3.50 | 4.00 | 2.00 | |
| Isoceteth-20 | | 0.50 | | | 2.00 | | | |
| Ceteareth-12 | | 5.00 | | 1.00 | | | 3.50 | 5.00 |
| Ceteareth-20 | | 5.00 | | 1.00 | | | | 3.50 |
| PEG-100 stearate | | | | 2.80 | | 2.30 | 3.30 | |
| Cetyl alcohol | 5.20 | | 1.20 | 1.00 | 1.30 | | 0.50 | 0.30 |
| Cetyl palmitate | 2.50 | 1.20 | | 1.50 | | 0.50 | | 1.50 |
| Cetyldimethicone copolyol | | | | 0.50 | | 1.00 | | |
| Polyglyceryl-2 | | | | 0.75 | 0.30 | | | |
| P18 | 0.1 | 0.5 | 0.01 | 5.0 | 0.5 | 3.0 | 0.025 | 10.0 |
| Dihydroxyacetone | | | 3.00 | 5.00 | | | 4.00 | |
| Uvinul ® A Plus ™ | 2.00 | 1.50 | 0.75 | 1.00 | 2.10 | 4.50 | 5.00 | 2.10 |
| Titanium dioxide-microfine | 1.00 | | 1.50 | | 3.50 | | 1.50 | 1.00 |
| Zinc oxide-microfine | | 1.00 | | 0.25 | | 2.00 | | 1.50 |
| $C_{12-15}$-Alkyl benzoate | 3.50 | | | 6.35 | | | | 0.10 |
| Cocoglyceride | | 3.00 | | 3.00 | | | | 1.00 |
| Dicapryl ether | 4.50 | | | | | | | |
| Dicaprylyl carbonate | | 4.30 | | 3.00 | | | 7.00 | |
| Dibutyl adipate | | | | 0.50 | | | | 0.30 |
| Phenyltrimethicone | 2.00 | | | 3.50 | | 2.00 | | |
| Cyclomethicone | | 3.00 | | | | | | |
| $C_{1-5}$-Alkylgalactomannan | | 0.50 | | | 2.00 | | | |
| Hydrogenated cocoglyceride | | | | | 3.00 | 4.00 | | |
| Behenoxydimethicone | | | | | | 1.50 | 2.00 | |
| VP/hexadecene copolymer | | | | 1.00 | 1.20 | | | |
| Glycerol | 4.00 | 6.00 | 5.00 | | 8.00 | 10.00 | | |
| Vitamin E acetate | 0.20 | 0.30 | 0.40 | | 0.30 | | | |
| *Butyrosperumu parkii* (shea butter) | | 2.00 | | 3.60 | | 2.00 | | |
| Iodopropyl butylcarbamate | 0.12 | | | | 0.20 | | | |
| DMDM hydantoin | 0.10 | | | | 0.12 | | 0.13 | |
| Methyl paraben | | 0.50 | 0.30 | | 0.35 | | | |
| Phenoxyethanol | 0.50 | 0.40 | | 1.00 | | | | |
| Ethylhexylglycerol | | 0.30 | | | 1.00 | | 0.35 | |
| Ethanol | 2.00 | | 2.00 | | | 5.00 | | |
| Trisodium EDTA | 0.40 | | 0.15 | | | 0.20 | | |
| Perfume oil | 0.20 | | 0.20 | | 0.24 | 0.16 | 0.10 | 0.10 |
| Aqua dem. | ad 100 | ad 100 | ad 100 | ad 100 | ad 100 | ad 100 | ad 100 | ad 100 |

(23) Oil Gel

|  | 1 | 2 | 3 | 4 |
|---|---|---|---|---|
| Caprylic/capric triglycerides | 12.00 | 10.00 | 6.00 | |
| Octyldodecanol | 7.00 | 14.00 | 8.00 | 3.00 |
| Butylene glycol dicaprylate/dicaprate | | | | 12.00 |
| Pentaerythrityl tetraisostearate | 10.00 | 6.00 | 8.00 | 7.00 |
| Polyglyceryl-3 diisostearate | 2.50 | | | |
| Bisdiglyceryl polyacyladipate-2 | 9.00 | 8.00 | 10.00 | 8.00 |
| Myristyl myristate | 3.50 | 3.00 | 4.00 | 3.00 |
| Quaternium-18 bentonite | 5.00 | 5.00 | 6.00 | 6.00 |
| Propylene carbonate | 15.00 | 20.00 | 18.00 | 19.50 |
| P18 | 1.0 | 0.5 | 3.0 | 5.0 |
| Vitamin acetate | 0.50 | 1.00 | | |
| Ascorbyl palmitate | 0.05 | | 0.05 | |
| *Buxus chinensis* (jojoba) oil | 2.00 | 1.00 | | 1.00 |
| Perfume oil, BHT | 0.10 | 0.25 | | 0.35 |
| *Ricinus communis* (castor) oil | ad 100 | ad 100 | ad 100 | ad 100 |

Example 38

Cosmetic Sunscreen Preparations

The formulations below describe cosmetic sunscreen preparations comprising a combination of at least one inorganic pigment, preferably zinc oxide and/or titanium dioxide, and organic UV-A and UV-B filters.

The formulations given below are prepared in a customary manner known to the person skilled in the art.

The content of P18 refers to 100% of active ingredient. The active ingredient according to the invention can either be used in pure form or in the form of an aqueous solution. In the case of the aqueous solution, the content of water dem. in the particular formulation has to be adjusted.

(1)

| | | | |
|---|---|---|---|
| A | 7.50 | Uvinul MC 80 | Ethylhexyl cinnamate |
| | 2.00 | Uvinul M 40 | Benzophenone-3 |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | T-Lite SF | Titanium dioxide, aluminum oxide hydrate, dimethicone/methicone copolymer |
| | 1.00 | Cetiol SB 45 | *Butyrospermum parkii* (shea butter) |
| | 6.50 | Finsolv TN | $C_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 1.00 | Sepigel 305 | Polyacrylamide, $C_{13-14}$-isoparaffin, laureth-7 |
| | 1% | P18 | |
| | q.s. | | Preservative |

(2)

| | | | |
|---|---|---|---|
| A | 7.50 | Uvinul MC 80 | Ethylhexyl cinnamate |
| | 2.00 | Uvinul M 40 | Benzophenone-3 |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | Z-COTE MAX | Zinc oxide (and) diphenylcaprylmethicone |
| | 1.00 | Cetiol SB 45 | *Butyrospermum parkii* (shea butter) |
| | 6.50 | Finsolv TN | $C_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 2.00 | Simulgel NS | Hydroxyethyl acrylate/sodium acryloyldimethyltaurate copolymer, squalane, polysorbate 60 |
| | 1% | P18 | |
| | q.s. | | Preservative |

(3)

| | | | |
|---|---|---|---|
| A | 7.50 | Uvinul MC 80 | Ethylhexyl cinnamate |
| | 2.00 | Uvinul A Plus | Diethylaminohydroxybenzoylhexyl benzoate |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | Z-COTE MAX | Zinc oxide (and) diphenylcaprylmethicone |
| | 1.00 | Cetiol SB 45 | *Butyrospermum parkii* (shea butter) |
| | 6.50 | Finsolv TN | $C_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 2.00 | Simulgel NS | Hydroxyethyl acrylate/sodium acryloyldimethyltaurate copolymer, squalane, polysorbate 60 |
| | 1% | P18 | |
| | q.s. | | Preservative |

(4)

| | | | |
|---|---|---|---|
| A | 4.00 | Uvinul MC 80 | Ethylhexyl cinnamate |
| | 2.00 | Uvinul T 150 | Ethylhexyltriazone |
| | 2.00 | Uvinul A Plus | Diethylaminohydroxybenzoylhexyl benzoate |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | Z-COTE MAX | Zinc oxide (and) diphenylcaprylmethicone |
| | 1.00 | Cetiol SB 45 | *Butyrospermum parkii* (shea butter) |
| | 6.50 | Finsolv TN | $C_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 2.00 | Simulgel NS | Hydroxyethyl acrylate/sodium acryloyldimethyltaurate copolymer, squalane, polysorbate 60 |
| | 1% | P18 | |
| | q.s. | | Preservative |

(5)

| | | | |
|---|---|---|---|
| A | 4.00 | Uvinul MC 80 | Ethylhexyl cinnamate |
| | 2.00 | Uvinul T 150 | Ethylhexyltriazone |
| | 2.00 | Uvinul A Plus | Diethylaminohydroxybenzoylhexyl benzoate |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | T-Lite SF | Titanium dioxide, aluminum hydrate, dimethicone/methicone copolymer |
| | 1.00 | Cetiol SB 45 | *Butyrospermum parkii* (shea butter) |
| | 6.50 | Finsolv TN | $C_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 2.00 | Simulgel NS | Hydroxyethyl acrylate/sodium acryloyldimethyltaurate copolymer, squalane, polysorbate 60 |
| | 1% | P18 | |
| | q.s. | | Preservative |

(6)

| | | | |
|---|---|---|---|
| A | 4.00 | Uvinul MC 80 | Ethylhexyl cinnamate |
| | 2.00 | Uvinul T 150 | Ethylhexyltriazone |
| | 2.00 | Uvinul A Plus | Diethylaminohydroxybenzoylhexyl benzoate |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | Z-COTE MAX | Zinc oxide (and) diphenylcaprylmethicone |

(7)

| | | | |
|---|---|---|---|
| C | 1.00 | Cetiol SB 45 | *Butyrospermum parkii* (shea butter) |
| | 6.50 | Finsolv TN | C$_{12-15}$-Alkyl benzoate |
| | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 2.00 | Simulgel NS | Hydroxyethyl acrylate/sodium acryloyldimethyltaurate copolymer, squalane, polysorbate 60 |
| | 1% | P18 | |
| | q.s. | | Preservative |

(8)

| | | | |
|---|---|---|---|
| A | 4.00 | Uvinul MC 80 | Ethylhexyl cinnamate |
| | 1.00 | Uvinul T 150 | Ethylhexyltriazone |
| | 2.00 | Parsol 1789 | Butylmethoxydibenzoylmethane |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | T-Lite SF-S | Titanium dioxide, silicon hydrate, aluminum hydrate, methicone/dimethicone copolymer |
| | 1.00 | Cetiol SB 45 | *Butyrospermum parkii* (shea butter) |
| | 6.50 | Finsolv TN | C$_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.70 | Water dem. | Aqua dem. |
| D | 2.00 | Simulgel NS | Hydroxyethyl acrylate/sodium acryloyldimethyltaurate copolymer, squalane, polysorbate 60 |
| | 0.5% | P18 | |
| | q.s. | | Preservative |

(9)

| | | | |
|---|---|---|---|
| A | 4.00 | Uvinul MC 80 | Ethylhexyl cinnamate |
| | 1.00 | Uvinul T 150 | Ethylhexyltriazone |
| | 2.00 | Parsol 1789 | Butylmethoxydibenzoylmethane |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | Z-COTE MAX | Zinc oxide (and) diphenylcaprylmethicone |
| | 1.00 | Cetiol SB 45 | *Butyrospermum parkii* (shea butter) |
| | 6.50 | Finsolv TN | C$_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 67.10 | Water dem. | Aqua dem. |
| D | 2.00 | Simulgel NS | Hydroxyethyl acrylate/sodium acryloyldimethyltaurate copolymer, squalane, polysorbate 60 |
| | 0.1% | P18 | |
| | q.s. | | Preservative |

| | | | |
|---|---|---|---|
| A | 5.00 | Uvinul N 539 T | Octocrylene |
| | 2.00 | Parsol 1789 | Butylmethoxydibenzoylmethane |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | T-Lite SF-S | Titanium dioxide, silicon hydrate, aluminum hydrate, methicone/dimethicone copolymer |
| | 1.00 | Cetiol SB 45 | *Butyrospermum parkii* (shea butter) |
| | 6.50 | Finsolv TN | C$_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.20 | Water dem. | Aqua dem. |
| D | 2.00 | Simulgel NS | Hydroxyethyl acrylate/sodium acryloyldimethyltaurate copolymer, squalane, polysorbate 60 |
| | 1% | P18 | |
| | q.s. | | Preservative |

(10)

| | | | |
|---|---|---|---|
| A | 5.00 | Uvinul N 539 T | Octocrylene |
| | 2.00 | Uvinul A Plus | Diethylaminohydroxybenzoylhexyl benzoate |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | T-Lite SF | Titanium dioxide, aluminum hydrate, dimethicone/methicone copolymer |
| | 1.00 | Cetiol SB 45 | *Butyrospermum parkii* (shea butter) |
| | 6.50 | Finsolv TN | C$_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 65.20 | Water dem. | Aqua dem. |
| D | 2.00 | Simulgel NS | Hydroxyethyl acrylate/sodium acryloyldimethyltaurate copolymer, squalane, polysorbate 60 |
| | 2% | P18 | |
| | q.s. | | Preservative |

(11)

| | | | |
|---|---|---|---|
| A | 5.00 | Uvinul N 539 T | Octocrylene |
| | 2.00 | Uvinul A Plus | Diethylaminohydroxybenzoylhexyl benzoate |
| | 0.80 | Rylo PG 11 | Polyglyceryl dimer soyate |
| | 1.00 | Span 60 | Sorbitan stearate |
| | 0.50 | Vitamin E acetate | Tocopheryl acetate |
| | 3.00 | Dracorin 100 SE | Glyceryl stearate, PEG-100 stearate |
| | 1.00 | Cremophor CO 410 | PEG-40-hydrogenated castor oil |
| B | 3.00 | Z-COTE MAX | Zinc oxide (and) diphenylcaprylmethicone |
| | 1.00 | Cetiol SB 45 | *Butyrospermum parkii* (shea butter) |
| | 6.50 | Finsolv TN | C$_{12-15}$-Alkyl benzoate |
| C | 5.00 | Butylene glycol | Butylene glycol |
| | 0.30 | Keltrol | Xanthan gum |
| | 0.10 | Edeta BD | Disodium EDTA |
| | 0.10 | Allantoin | Allantoin |
| | 66.70 | Water dem. | Aqua dem. |
| D | 2.00 | Simulgel NS | Hydroxyethyl acrylate/sodium acryloyldimethyltaurate copolymer, squalane, polysorbate 60 |
| | 0.5% | P18 | |
| | q.s. | | Preservative |

(12)

| | | | |
|---|---|---|---|
| A | 5.00 | Uvinul N 539 T | Octocrylene |
| | 2.00 | Uvinul A Plus | Diethylaminohydroxybenzoylhexyl benzoate |

-continued

|   |       |                  |                                                                                 |
|---|-------|------------------|---------------------------------------------------------------------------------|
|   | 0.80  | Rylo PG 11       | Polyglyceryl dimer soyate                                                       |
|   | 1.00  | Span 60          | Sorbitan stearate                                                               |
|   | 0.50  | Vitamin E acetate| Tocopheryl acetate                                                              |
|   | 3.00  | Dracorin 100 SE  | Glyceryl stearate, PEG-100 stearate                                             |
|   | 1.00  | Cremophor CO 410 | PEG-40-hydrogenated castor oil                                                  |
| B | 3.00  | Z-COTE MAX       | Zinc oxide (and) diphenylcaprylmethicone                                        |
|   | 1.00  | Cetiol SB 45     | *Butyrospermum parkii* (shea butter)                                            |
|   | 6.50  | Finsolv TN       | $C_{12-15}$-Alkyl benzoate                                                      |
| C | 5.00  | Butylene glycol  | Butylene glycol                                                                 |
|   | 0.30  | Keltrol          | Xanthan gum                                                                     |
|   | 0.10  | Edeta BD         | Disodium EDTA                                                                   |
|   | 0.10  | Allantoin        | Allantoin                                                                       |
|   | 2.0   | Mexoryl SX       | Terephthalidenedicamphorsulfonic acid                                           |
|   | 66.20 | Water dem.       | Aqua dem.                                                                       |
| D | 2.00  | Simulgel NS      | Hydroxyethyl acrylate/sodium acryloyldimethyltaurate copolymer, squalane, polysorbate 60 |
|   | 1%    | P18              |                                                                                 |
|   | q.s.  |                  | Preservative                                                                    |

(13)

|   |       |                  |                                                                                 |
|---|-------|------------------|---------------------------------------------------------------------------------|
| A | 5.00  | Uvinul N 539 T   | Octocrylene                                                                     |
|   | 2.00  | Uvinul A Plus    | Diethylaminohydroxybenzoylhexyl benzoate                                        |
|   | 0.80  | Rylo PG 11       | Polyglyceryl dimer soyate                                                       |
|   | 1.00  | Span 60          | Sorbitan stearate                                                               |
|   | 0.50  | Vitamin E acetate| Tocopheryl acetate                                                              |
|   | 3.00  | Dracorin 100 SE  | Glyceryl stearate, PEG-100 stearate                                             |
|   | 1.00  | Cremophor CO 410 | PEG-40-hydrogenated castor oil                                                  |
| B | 3.00  | Z-COTE MAX       | Zinc oxide (and) diphenylcaprylmethicone                                        |
|   | 1.00  | Cetiol SB 45     | *Butyrospermum parkii* (shea butter)                                            |
|   | 6.50  | Finsolv TN       | $C_{12-15}$-Alkyl benzoate                                                      |
| C | 5.00  | Butylene glycol  | Butylene glycol                                                                 |
|   | 0.30  | Keltrol          | Xanthan gum                                                                     |
|   | 0.10  | Edeta BD         | Disodium EDTA                                                                   |
|   | 0.10  | Allantoin        | Allantoin                                                                       |
|   | 2.0   | Mexoryl SX       | Terephthalidenedicamphorsulfonic acid                                           |
|   | 65.20 | Water dem.       | Aqua dem.                                                                       |
| D | 2.00  | Simulgel NS      | Hydroxyethyl acrylate/sodium acryloyldimethyltaurate copolymer, squalane, polysorbate 60 |
|   | 2%    | P18              |                                                                                 |
|   | q.s.  |                  | Preservative                                                                    |

(14)

|   |       |                  |                                                                                 |
|---|-------|------------------|---------------------------------------------------------------------------------|
| A | 5.00  | Uvinul N 539 T   | Octocrylene                                                                     |
|   | 2.00  | Uvinul A Plus    | Diethylaminohydroxybenzoylhexyl benzoate                                        |
|   | 2.00  | Mexoryl XL       | Drometrizole trisiloxane                                                        |
|   | 0.80  | Rylo PG 11       | Polyglyceryl dimer soyate                                                       |
|   | 1.00  | Span 60          | Sorbitan stearate                                                               |
|   | 0.50  | Vitamin E acetate| Tocopheryl acetate                                                              |
|   | 3.00  | Dracorin 100 SE  | Glyceryl stearate, PEG-100 stearate                                             |
|   | 1.00  | Cremophor CO 410 | PEG-40-hydrogenated castor oil                                                  |
| B | 3.00  | Z-COTE MAX       | Zinc oxide (and) diphenylcaprylmethicone                                        |
|   | 1.00  | Cetiol SB 45     | *Butyrospermum parkii* (shea butter)                                            |
|   | 6.50  | Finsolv TN       | $C_{12-15}$-Alkyl benzoate                                                      |
| C | 5.00  | Butylene glycol  | Butylene glycol                                                                 |
|   | 0.30  | Keltrol          | Xanthan gum                                                                     |
|   | 0.10  | Edeta BD         | Disodium EDTA                                                                   |
|   | 0.10  | Allantoin        | Allantoin                                                                       |
|   | 67.10 | Water dem.       | Aqua dem.                                                                       |
| D | 2.00  | Simulgel NS      | Hydroxyethyl acrylate/sodium acryloyldimethyltaurate copolymer, squalane, polysorbate 60 |
|   | 0.1%  | P18              |                                                                                 |
|   | q.s.  |                  | Preservative                                                                    |

(15)

|   |       |                  |                                                                                 |
|---|-------|------------------|---------------------------------------------------------------------------------|
| A | 5.00  | Uvinul N 539 T   | Octocrylene                                                                     |
|   | 2.00  | Tinosorb S       | Bisethylhexyloxyphenol methoxyphenyltriazine                                    |
|   | 0.80  | Rylo PG 11       | Polyglyceryl dimer soyate                                                       |
|   | 1.00  | Span 60          | Sorbitan stearate                                                               |
|   | 0.50  | Vitamin E acetate| Tocopheryl acetate                                                              |
|   | 3.00  | Dracorin 100 SE  | Glyceryl stearate, PEG-100 stearate                                             |
|   | 1.00  | Cremophor CO 410 | PEG-40-hydrogenated castor oil                                                  |
| B | 3.00  | Z-COTE MAX       | Zinc oxide (and) diphenylcaprylmethicone                                        |
|   | 1.00  | Cetiol SB 45     | *Butyrospermum parkii* (shea butter)                                            |
|   | 6.50  | Finsolv TN       | $C_{12-15}$-Alkyl benzoate                                                      |
| C | 5.00  | Butylene glycol  | Butylene glycol                                                                 |
|   | 0.30  | Keltrol          | Xanthan gum                                                                     |
|   | 0.10  | Edeta BD         | Disodium EDTA                                                                   |
|   | 0.10  | Allantoin        | Allantoin                                                                       |
|   | 66.20 | Water dem.       | Aqua dem.                                                                       |
| D | 2.00  | Simulgel NS      | Hydroxyethyl acrylate/sodium acryloyldimethyltaurate copolymer, squalane, polysorbate 60 |
|   | 1%    | P18              |                                                                                 |
|   | q.s.  |                  | Preservative                                                                    |

(16)

|   |       |                  |                                                                                 |
|---|-------|------------------|---------------------------------------------------------------------------------|
| A | 7.50  | Uvinul MC 80     | Ethylhexyl methoxycinnamate                                                     |
|   | 5.00  | Uvinul N 539 T   | Octocrylene                                                                     |
|   | 3.00  | Emulgade PL 68/50| Cetearyl glucoside, cetearyl alcohol                                            |
|   | 2.00  | Dracorin 100 SE  | Glyceryl stearate, PEG-100 stearate                                             |
|   | 1.00  | Fitoderm         | Squalane                                                                        |
|   | 0.50  | Cremophor WO 7   | PEG-7-hydrogenated castor oil                                                   |
|   | 0.50  | Cremophor PS 20  | Polysorbate 20                                                                  |
|   | 2.00  | Dry Flo Pure     | Aluminum starch octenyl succinate                                               |
| B | 5.00  | Z-COTE MAX       | Zinc oxide (and) diphenylcaprylmethicone                                        |
| C | 4.00  | 1,2-Propylene glycol Care | Propylene glycol                                                       |
|   | 0.20  | Keltrol          | Xanthan gum                                                                     |
|   | 0.50  | Simulgel 600     | Acrylamide/sodium acryloyldimethyltaurate copolymer, isohexadecane, polysorbate 80 |
|   | ad 100| Water dem.       | Aqua dem.                                                                       |
|   | q.s.  |                  | Preservative                                                                    |
|   | 0.50  | Vitamin E acetate| Tocopheryl acetate                                                              |
|   | 2%    | P18              |                                                                                 |
|   | 1.00  | RetiSTAR         | Caprylic/capric triglyceride, sodium ascorbate, tocopherol, retinol             |

(17)

|   |       |                  |                                                                                 |
|---|-------|------------------|---------------------------------------------------------------------------------|
| A | 7.50  | Uvinul MC 80     | Ethylhexyl methoxycinnamate                                                     |
|   | 2.00  | Uvinul N 539 T   | Octocrylene                                                                     |
|   | 3.00  | Emulgade PL 68/50| Cetearyl glucoside, cetearyl alcohol                                            |
|   | 2.00  | Dracorin 100 SE  | Glyceryl stearate, PEG-100 stearate                                             |
|   | 1.00  | Fitoderm         | Squalane                                                                        |
|   | 0.50  | Cremophor WO 7   | PEG-7-hydrogenated castor oil                                                   |
|   | 0.50  | Cremophor PS 20  | Polysorbate 20                                                                  |
|   | 2.00  | Dry Flo Pure     | Aluminum starch octenyl succinate                                               |
| B | 5.00  | T-Lite SF-S      | Titanium dioxide, silicon hydrate, aluminum hydrate, methicone/dimethicone copolymer |
| C | 4.00  | 1,2-Propylene glycol Care | Propylene glycol                                                       |
|   | 0.20  | Keltrol          | Xanthan gum                                                                     |
|   | 0.50  | Simulgel 600     | Acrylamide/sodium acryloyldimethyltaurate copolymer, isohexadecane, polysorbate 80 |
|   | ad 100| Water dem.       | Aqua dem.                                                                       |
|   | q.s.  |                  | Preservative                                                                    |
|   | 0.50  | Vitamin E acetate| Tocopheryl acetate                                                              |
|   | 1%    | P18              |                                                                                 |
|   | 2.00  | RetiSTAR         | Caprylic/capric triglyceride, sodium ascorbate, tocopherol, retinol             |

(18)

| | | | |
|---|---|---|---|
| A | 7.50 | Uvinul MC 80 | Ethylhexyl methoxycinnamate |
| | 5.00 | Uvinul N 539 T | Octocrylene |
| | 3.00 | Emulgade PL 68/50 | Cetearyl glucoside, cetearyl alcohol |
| | 2.00 | Dracorin 100 SE | Glyceryl stearate, PEG-100 stearate |
| | 1.00 | Fitoderm | Squalane |
| | 0.50 | Cremophor WO 7 | PEG-7-hydrogenated castor oil |
| | 0.50 | Cremophor PS 20 | Polysorbate 20 |
| | 2.00 | Dry Flo Pure | Aluminum starch octenyl succinate |
| B | 5.00 | T-Lite SF | Titanium dioxide, aluminum hydrate, dimethicone/methicone copolymer |
| C | 4.00 | 1,2-Propylene glycol Care | Propylene glycol |
| | 1.00 | D-Panthenol 50 P | Panthenol, propylene glycol |
| | 0.20 | Keltrol | Xanthan gum |
| | 0.50 | Simulgel 600 | Acrylamide/sodium acryloyldimethyltaurate copolymer, isohexadecane, polysorbate 80 |
| | ad 100 | Water dem. | Aqua dem. |
| | q.s. | Preservative | |
| | 0.50 | Vitamin E acetate | Tocopheryl acetate |
| | 1% | P18 | |
| | 1.00 | RetiSTAR | Caprylic/capric triglyceride, sodium ascorbate, tocopherol, retinol |

(19)

| | | | |
|---|---|---|---|
| A | 5.50 | Uvinul MC 80 | Ethylhexyl methoxycinnamate |
| | 2.00 | Uvinul A Plus | Diethylaminohydroxybenzoylhexyl benzoate |
| | 3.00 | Uvinul N 539 T | Octocrylene |
| | 3.00 | Emulgade PL 68/50 | Cetearyl glucoside, cetearyl alcohol |
| | 2.00 | Dracorin 100 SE | Glyceryl stearate, PEG-100 stearate |
| | 1.00 | Fitoderm | Squalane |
| | 0.50 | Cremophor WO 7 | PEG-7-hydrogenated castor oil |
| | 0.50 | Cremophor PS 20 | Polysorbate 20 |
| | 2.00 | Dry Flo Pure | Aluminum starch octenyl succinate |
| B | 5.00 | T-Lite SF | Titanium dioxide, aluminum hydrate, dimethicone/methicone copolymer |
| C | 4.00 | 1,2-Propylene glycol Care | Propylene glycol |
| | 0.20 | Keltrol | Xanthan gum |
| | 0.50 | Simulgel 600 | Acrylamide/sodium acryloyldimethyltaurate copolymer, isohexadecane, polysorbate 80 |
| | ad 100 | Water dem. | Aqua dem. |
| | q.s. | Preservative | |
| | 0.50 | Vitamin E acetate | Tocopheryl acetate |
| | 2% | P18 | |
| | 1.00 | RetiSTAR | Caprylic/capric triglyceride, sodium ascorbate, tocopherol, retinol |

(20)

| | | | |
|---|---|---|---|
| A | 1.00 | Abil Care 85 | Bis-PEG-/PPG-16-/16 PEG-/PPG-16-/16-dimethicone, caprylic/capric triglyceride |
| | 3.00 | Cremophor CO 40 | PEG-40-hydrogenated castor oil |
| | 0.30 | Cremophor WO 7 | PEG-7-hydrogenated castor oil |
| | 2.00 | Parsol 1789 | Butylmethoxydibenzoylmethane |
| | 2.00 | Mexoryl XL | Drometrizoletrisiloxane |
| | 10.00 | Witconol APM | PPG-3 myristyl ether |
| | 1.00 | Uvinul T 150 | Ethylhexyltriazone |
| | 1.00 | Dow Corning 345 Fluid | Cyclopentasiloxane, cyclohexasiloxane |
| | 5.00 | Uvinul N 539 T | Octocrylene |
| B | 3.00 | Z-COTE MAX | Zinc oxide (and) diphenylcaprylmethicone |
| C | 5.00 | 1,2-Propylene glycol | Propylene glycol |
| | 1.00 | Mexoryl SX | Terephthalidenedicamphorsulfonic acid |
| | 0.20 | Keltrol | Xanthan gum |
| | 0.06 | Edeta BD | Disodium EDTA |
| | 0.04 | TEA | Triethanolamine |
| | 0.30 | Carbopol Ultrez 10P | Carbomer |
| | 63.50 | Water dem. | Aqua dem. |
| | 1% | P18 | |
| D | q.s. | Perfume oil | |
| | 0.50 | Glydant | DMDM hydantoin |

(21)

| | | | |
|---|---|---|---|
| A | 5.50 | Uvinul MC 80 | Ethylhexyl methoxycinnamate |
| | 2.00 | Uvinul A Plus | Diethylaminohydroxybenzoylhexyl benzoate |
| | 3.00 | Uvinul N 539 T | Octocrylene |
| | 3.00 | Emulgade PL 68/50 | Cetearyl glucoside, cetearyl alcohol |
| | 2.00 | Dracorin 100 SE | Glyceryl stearate, PEG-100 stearate |
| | 1.00 | Fitoderm | Squalane |
| | 0.50 | Cremophor WO 7 | PEG-7-hydrogenated castor oil |
| | 0.50 | Cremophor PS 20 | Polysorbate 20 |
| | 2.00 | Dry Flo Pure | Aluminum starch octenyl succinate |
| B | 5.00 | T-Lite SF-S | Titanium dioxide, silicon hydrate, aluminum hydrate, methicone/dimethicone copolymer |
| C | 4.00 | 1,2-Propylene glycol Care | Propylene glycol |
| | 0.20 | Keltrol | Xanthan gum |
| | 2.00 | Simulgel NS | Hydroxyethyl acrylate/sodium acryloyldimethyltaurate copolymer, squalane, polysorbate 60 |
| | 66.30 | Water dem. | Aqua dem. |
| | q.s. | Preservative | |
| | 0.50 | Vitamin E acetate | Tocopheryl acetate |
| | 0.5% | P18 | |
| | 1.00 | RetiSTAR | Caprylic/capric triglyceride, sodium ascorbate, tocopherol, retinol |

(22)

| | | | |
|---|---|---|---|
| A | 2.00 | Cremophor A 6 | Ceteareth-6, stearyl alcohol |
| | 2.00 | Cremophor A 25 | Ceteareth-25 |
| | 3.00 | Syncrowax HRC | Tribehenin |
| | 2.00 | Lanette O | Cetearyl alcohol |
| | 2.00 | Luvitol EHO | Cetearyl ethylhexanoate |
| | 5.00 | Uvinul MC 80 | Ethylhexyl methoxycinnamate |
| | 1.00 | Ganex V-220 | VP/eicosene copolymer |
| | 7.00 | Isopropyl palmitate | Isopropyl palmitate |
| B | 3.00 | Z-COTE MAX | Zinc oxide (and) diphenylcaprylmethicone |
| C | 0.20 | Keltrol | Xanthan gum |
| | 0.50 | Simulgel NS | Hydroxyethyl acrylate/sodium acryloyldimethyltaurate copolymer, squalane, polysorbate 60 |
| | 65.10 | Water dem. | Aqua dem. |
| | 0.20 | Edeta BD | Disodium EDTA |
| | 5.00 | 1,2-Propylene glycol Care | Propylene glycol |
| | 0.5% | P18 | |
| D | 1.00 | Vitamin E acetate | Tocopheryl acetate |
| | q.s. | Preservative | |

(23)

| | | | |
|---|---|---|---|
| A | 2.00 | Cremophor A 6 | Ceteareth-6, stearyl alcohol |
| | 2.00 | Cremophor A 25 | Ceteareth-25 |
| | 3.00 | Syncrowax HRC | Tribehenin |
| | 2.00 | Lanette O | Cetearyl alcohol |
| | 2.00 | Luvitol EHO | Cetearyl ethylhexanoate |
| | 5.00 | Uvinul MC 80 | Ethylhexyl methoxycinnamate |
| | 1.00 | Ganex V-220 | VP/eicosene copolymer |
| | 7.00 | Isopropyl palmitate | Isopropyl palmitate |
| B | 3.00 | T-Lite SF | Titanium dioxide, aluminum hydrate, dimethicone/methicone copolymer |
| C | 0.50 | Keltrol | Xanthan gum |
| | 0.50 | Simulgel NS | Hydroxyethyl acrylate/sodium acryloyldimethyltaurate copolymer, squalane, polysorbate 60 |

-continued

|   |       |                       |                      |
|---|-------|-----------------------|----------------------|
|   | 65.10 | Water dem.            | Aqua dem.            |
|   | 0.20  | Edeta BD              | Disodium EDTA        |
|   | 5.00  | 1,2-Propylene glycol Care | Propylene glycol |
|   | 0.5%  | P18                   |                      |
| D | 1.00  | Vitamin E acetate     | Tocopheryl acetate   |
|   | q.s.  | Preservative          |                      |

(24)

|   |       |                       |                      |
|---|-------|-----------------------|----------------------|
| A | 2.00  | Cremophor A 6         | Ceteareth-6, stearyl alcohol |
|   | 2.00  | Cremophor A 25        | Ceteareth-25         |
|   | 3.00  | Syncrowax HRC         | Tribehenin           |
|   | 2.00  | Lanette O             | Cetearyl alcohol     |
|   | 2.00  | Luvitol EHO           | Cetearyl ethylhexanoate |
|   | 5.00  | Uvinul MC 80          | Ethylhexyl methoxycinnamate |
|   | 1.00  | Ganex V-220           | VP/eicosene copolymer |
|   | 7.00  | Isopropyl palmitate   | Isopropyl palmitate  |
| B | 3.00  | T-Lite SF-S           | Titanium dioxide, silicon hydrate, aluminum hydrate, methicone/dimethicone copolymer |
| C | 0.50  | Keltrol               | Xanthan gum          |
|   | 0.50  | Simulgel NS           | Hydroxyethyl acrylate/sodium acryloyldimethyltaurate copolymer, squalane, polysorbate 60 |
|   | 64.60 | Water dem.            | Aqua dem.            |
|   | 0.20  | Edeta BD              | Disodium EDTA        |
|   | 5.00  | 1,2-Propylene glycol Care | Propylene glycol |
|   | 1%    | P18                   |                      |
| D | 1.00  | Vitamin E acetate     | Tocopheryl acetate   |
|   | q.s.  | Preservative          |                      |

(25)

|   |       |                       |                      |
|---|-------|-----------------------|----------------------|
| A | 2.00  | Cremophor A 6         | Ceteareth-6, stearyl alcohol |
|   | 2.00  | Cremophor A 25        | Ceteareth-25         |
|   | 3.00  | Syncrowax HRC         | Tribehenin           |
|   | 2.00  | Lanette O             | Cetearyl alcohol     |
|   | 2.00  | Luvitol EHO           | Cetearyl ethylhexanoate |
|   | 5.00  | Uvinul MC 80          | Ethylhexyl methoxycinnamate |
|   | 1.00  | Ganex V-220           | VP/eicosene copolymer |
|   | 7.00  | Isopropyl palmitate   | Isopropyl palmitate  |
| B | 3.00  | T-Lite SF-S           | Titanium dioxide, silicon hydrate, aluminum hydrate, methicone/dimethicone copolymer |
| C | 0.50  | Keltrol               | Xanthan gum          |
|   | 0.50  | Simulgel NS           | Hydroxyethyl acrylate/sodium acryloyldimethyltaurate copolymer, squalane, polysorbate 60 |
|   | 64.10 | Water dem.            | Aqua dem.            |
|   | 2.00  | Neoheliopan AP        | Disodium phenyldibenzimidazoletetrasulfonate |
|   | 0.20  | Edeta BD              | Disodium EDTA        |
|   | 5.00  | 1,2-Propylene glycol Care | Propylene glycol |
| D | 1.00  | Vitamin E acetate     | Tocopheryl acetate   |
|   | 1%    | P18                   |                      |
|   | q.s.  | Preservative          |                      |

(26)

|   |       |                       |                      |
|---|-------|-----------------------|----------------------|
| A | 2.00  | Cremophor A 6         | Ceteareth-6, stearyl alcohol |
|   | 2.00  | Cremophor A 25        | Ceteareth-25         |
|   | 3.00  | Syncrowax HRC         | Tribehenin           |
|   | 2.00  | Lanette O             | Cetearyl alcohol     |
|   | 2.00  | Luvitol EHO           | Cetearyl ethylhexanoate |
|   | 7.00  | Uvinul N 539 T        | Octocrylene          |
|   | 1.00  | Ganex V-220           | VP/eicosene copolymer |
|   | 7.00  | Isopropyl palmitate   | Isopropyl palmitate  |
| B | 3.00  | T-Lite SF-S           | Titanium dioxide, silicon hydrate, aluminum hydrate, methicone/dimethicone copolymer |
| C | 0.50  | Keltrol               | Xanthan gum          |
|   | 0.50  | Simulgel NS           | Hydroxyethyl acrylate/sodium acryloyldimethyltaurate copolymer, squalane, polysorbate 60 |
|   | 64.60 | Water dem.            | Aqua dem.            |
|   | 1.00  | Mexoryl SX            | Terephthalidenedicamphorsulfonic acid |
|   | 0.20  | Edeta BD              | Disodium EDTA        |
|   | 5.00  | 1,2-Propylene glycol Care | Propylene glycol |
| D | 1.00  | Vitamin E acetate     | Tocopheryl acetate   |
|   | 1%    | P18                   |                      |
|   | q.s.  | Preservative          |                      |

(27)

|   |       |                       |                      |
|---|-------|-----------------------|----------------------|
| A | 2.00  | Cremophor A 6         | Ceteareth-6, stearyl alcohol |
|   | 2.00  | Cremophor A 25        | Ceteareth-25         |
|   | 3.00  | Syncrowax HRC         | Tribehenin           |
|   | 2.00  | Lanette O             | Cetearyl alcohol     |
|   | 2.00  | Luvitol EHO           | Cetearyl ethylhexanoate |
|   | 2.00  | Mexoryl XL            | Drometrizole trisiloxane |
|   | 5.00  | Uvinul N 539 T        | Octocrylene          |
|   | 1.00  | Ganex V-220           | VP/eicosene copolymer |

-continued

|   | | | |
|---|---|---|---|
|   | 7.00 | Isopropyl palmitate | Isopropyl palmitate |
| B | 3.00 | T-Lite SF | Titanium dioxide, aluminum hydrate, dimethicone/methicone copolymer |
| C | 0.50 | Keltrol | Xanthan gum |
|   | 0.50 | Simulgel NS | Hydroxyethyl acrylate/sodium acryloyldimethyltaurate copolymer, squalane, polysorbate 60 |
|   | 65.10 | Water dem. | Aqua dem. |
|   | 0.20 | Edeta BD | Disodium EDTA |
|   | 5.00 | 1,2-Propylene glycol Care | Propylene glycol |
| D | 1.00 | Vitamin E acetate | Tocopheryl acetate |
|   | 0.5% | P18 | |
|   | q.s. | Preservative | |

(28)

|   | | |
|---|---|---|
| 1.00 | Urea | Urea |
| 2.00 | Neoheliopan AP | Disodium phenyldibenzimidazoletetrasulfonate |
| 2.00 | Glycerol 87% | Glycerol |
| 1.20 | Aristoflex AVC | Ammonium acryloyldimethyltaurate/VP copolymer |
| 71.30 | Water dem. | Aqua dem. |
| B 3.00 | Cremophor CO 40 | PEG-40-hydrogenated castor oil |
| q.s. | Perfume oil | |
| 5.00 | Miglyol 812 | Caprylic/capric triglyceride |
| 2.00 | Uvinul N 539 T | Octocrylene |
| 8.00 | Z-COTE MAX | Zinc oxide (and) diphenylcaprylmethicone |
| 0.1% | P18 | |
| q.s. | Preservative | |

(29)

|  |  |  |
|---|---|---|
| 5.00 | Z-COTE MAX | Zinc oxide (and) diphenylcaprylmethicone |
| 2.00 | Parsol 1789 | Butylmethoxydibenzoylmethane |
| 1.00 | Uvinul T150 | Ethylhexyltriazone |
| 5.00 | Uvinul MC 80 | Ethylhexyl methoxycinnamate |
| 2.00 | Uvinul T 539 N | Octocrylene |
| 0.50 | Abil 350 | Dimethicone |
| 2.75 | Carnico wax LT 20 | Carnauba (*Copernica cerifera*) wax, paraffins |
| 3.70 | Candelilla wax LT 281 LJ | Candelilla (*Euphorbia cerifera*) wax |
| 1.80 | Beeswax 3050 PH | Beeswax |
| 3.20 | TeCero-wax 30445 | Microcrystalline wax |
| 3.20 | TeCero-wax 1030 K | Microcrystalline wax |
| 1.34 | Cutina CP | Cetyl palmitate |
| 6.40 | Vaseline | Petrolatum |
| 7.30 | Softisan 100 | Hydrogenated cocoglycerides |
| 10.00 | Luvitol EHO | Cetearyl ethylhexanoate |
| 0.17 | Bisabolol nat. | Bisabolol |
| 1.84 | Vitamin E acetate | Tocopheryl acetate |
| 0.42 | D,L-Alpha-Tocopherol | Tocopherol |
| 1% | P18 | |
| 40.38 | Castor oil | Castor (*Ricinus communis*) oil |

(30)

|  |  |  |
|---|---|---|
| 5.00 | T-Lite SF | Titanium dioxide, aluminum hydrate, dimethicone/methicone copolymer |
| 2.00 | Parsol 1789 | Butylmethoxydibenzoylmethane |
| 1.00 | Uvinul T150 | Ethylhexyltriazone |
| 3.00 | Uvinul MC 80 | Ethylhexyl methoxycinnamate |
| 2.00 | Uvinul N 539 T | Octocrylene |
| 0.50 | Abil 350 | Dimethicone |
| 2.75 | Carnico wax LT 20 | Carnauba (*Copernica cerifera*) wax, paraffin |
| 3.70 | Candelilla wax LT 281 LJ | Candelilla (*Euphorbia cerifera*) wax |
| 1.80 | Beeswax 3050 PH | Beeswax |
| 3.20 | TeCero-wax 30445 | Microcrystalline wax |

-continued

|  |  |  |
|---|---|---|
| 3.20 | TeCero-wax 1030 K | Microcrystalline wax |
| 1.34 | Cutina CP | Cetyl palmitate |
| 6.40 | Vaseline | Petrolatum |
| 7.30 | Softisan 100 | Hydrogenated cocoglycerides |
| 10.00 | Luvitol EHO | Cetearyl ethylhexanoate |
| 0.17 | Bisabolol nat. | Bisabolol |
| 1.84 | Vitamin E acetate | Tocopheryl acetate |
| 0.42 | D,L-Alpha-Tocopherol | Tocopherol |
| 1% | P18 | |
| 40.38 | Castor oil | Castor (*Ricinus communis*) oil |

(31)

|  |  |  |
|---|---|---|
| 5.00 | T-Lite SF-S | Titanium dioxide, silicon hydrate, aluminum hydrate, methicone/dimethicone copolymer |
| 2.00 | Uvinul A Plus | Diethylaminohydroxybenzoylhexyl benzoate |
| 2.00 | Mexoryl XL | Drometrizole trisiloxane |
| 3.00 | Uvinul MC 80 | Ethylhexyl methoxycinnamate |
| 0.50 | Abil 350 | Dimethicone |
| 2.75 | Carnico wax LT 20 | Carnauba (*Copernica cerifera*) wax, paraffins |
| 3.70 | Candelilla wax LT 281 LJ | Candelilla (*Euphorbia cerifera*) wax |
| 1.80 | Beeswax 3050 PH | Beeswax |
| 3.20 | TeCero-wax 30445 | Microcrystalline wax |
| 3.20 | TeCero-wax 1030 K | Microcrystalline wax |
| 1.34 | Cutina CP | Cetyl palmitate |
| 6.40 | Vaseline | Petrolatum |
| 7.30 | Softisan 100 | Hydrogenated cocoglycerides |
| 10.00 | Luvitol EHO | Cetearyl ethylhexanoate |
| 0.17 | Bisabolol nat. | Bisabolol |
| 1.84 | Vitamin E acetate | Tocopheryl acetate |
| 0.42 | D,L-Alpha-Tocopherol | Tocopherol |
| 2% | P18 | |
| 39.38 | Castor oil | Castor (*Ricinus communis*) oil |

(32)

|   | | | |
|---|---|---|---|
| A | 6.00 | Cremophor WO 7 | PEG-7-hydrogenated castor oil |
|   | 2.00 | Elfacos ST 9 | PEG-45-/dodecyl glycol copolymer |
|   | 3.00 | Isopropyl myristate | Isopropylmyristate |
|   | 8.00 | Jojoba oil | *Simmondsia chinensis* (jojoba) seed oil |
|   | 4.00 | Uvinul MC 80 | Ethylhexyl methoxycinnamate |
|   | 2.00 | Uvinul A Plus | Diethylaminohydroxybenzoylhexyl benzoate |
|   | 1.00 | Abil 350 | Dimethicone |
| B | 5.00 | Z-COTE MAX | Zinc oxide (and) diphenylcaprylmethicone |
|   | 3.00 | T-Lite SF | Titanium dioxide, aluminum hydrate, dimethicone/methicone copolymer |
| C | 0.20 | Edeta BD | Disodium EDTA |
|   | 5.00 | Glycerol 87% | Glycerol |
|   | 0.30 | Chemag 2000 | Imidazolidinylurea |
|   | 59.00 | Water dem. | Aqua dem. |

(33)

|   |       |                      |                                                                                              |
|---|-------|----------------------|----------------------------------------------------------------------------------------------|
|   | 2.00  | Cremophor A 6        | Ceteareth-6, stearyl alcohol                                                                 |
|   | 2.00  | Cremophor A 25       | Ceteareth-25                                                                                 |
|   | 3.00  | Syncrowax HRC        | Tribehenin                                                                                   |
|   | 2.00  | Lanette O            | Cetearyl alcohol                                                                             |
|   | 2.00  | Luvitol EHO          | Cetearyl ethylhexanoate                                                                      |
|   | 5.00  | Uvinul MC 80         | Ethylhexyl methoxycinnamate                                                                  |
|   | 1.00  | Uvinul T 150         | Ethylhexyltriazone                                                                           |
|   | 1.00  | Ganex V-220          | VP/eicosene copolymer                                                                        |
|   | 7.00  | Isopropyl myristate  | Isopropyl myristate                                                                          |
| B | 5.00  | Z-COTE MAX           | Zinc oxide (and) diphenylcaprylmethicone                                                     |
| C | 0.20  | Keltrol              | Xanthan gum                                                                                  |
|   | 0.50  | Simulgel NS          | Hydroxyethyl acrylate/sodium acryloyldimethyltaurate copolymer, squalane, polysorbate 60     |
|   | 61.10 | Water dem.           | Aqua dem.                                                                                    |
|   | 0.20  | Edeta BD             | Disodium EDTA                                                                                |
|   | 5.00  | 1,2-Propylene glycol Care | Propylene glycol                                                                        |
| D | 1.00  | Vitamin E acetate    | Tocopheryl acetate                                                                           |
|   | 1.5%  | P18                  |                                                                                              |
|   | q.s.  | Preservative         |                                                                                              |

(34)

|   |      |                         |                                           |
|---|------|-------------------------|-------------------------------------------|
| A | 2.00 | Luvitol EHO             | Cetearyl ethylhexanoate                   |
|   | 5.00 | Paraffin oil            | Mineral oil                               |
|   | 5.00 | Z-COTE MAX              | Zinc oxide (and) diphenylcaprylmethicone  |
| B | 1.00 | Cremophor A 6           | Ceteareth-6, stearyl alcohol              |
|   | 2.00 | Cremophor A 25          | Ceteareth-25                              |
|   | 3.00 | Glycerol monostearate   | Glyceryl stearate                         |
|   | 4.00 | Cetylstearyl alcohol    | Cetearyl alcohol                          |
| C | 5.00 | 1,2-Propylene glycol Care | Propylene glycol                        |
|   | 7.50 | Luviquat Care           | Polyquaternium-44                         |
|   | q.s. | Preservative            |                                           |
|   | q.s. | Perfume oil             |                                           |

Continuation of previous formulation:

|   |      |             |           |
|---|------|-------------|-----------|
| D | q.s. | Perfume oil |           |
|   | 1%   | P18         |           |
|   | q.s. | Preservative |          |

|       |            |           |
|-------|------------|-----------|
| 1%    | P18        |           |
| 64.50 | Water dem. | Aqua dem. |

(35)

|       |                        |                                                                      |
|-------|------------------------|----------------------------------------------------------------------|
| 5.00  | T-Lite SF              | Titanium dioxide, aluminum hydrate, dimethicone/methicone copolymer  |
| 10.00 | Z-COTE MAX             | Zinc oxide (and) diphenylcaprylmethicone                             |
| 12.00 | Beeswax 3044 PH        | Beeswax                                                              |
| 8.00  | Candelilla wax LT 281 LJ | Candelilla (*Euphorbia cerifera*) wax                              |
| 5.00  | Tegin                  | Glyceryl stearate SE                                                 |
| 5.00  | Dow Corning 345 Fluid  | Cyclopentasiloxane, cyclohexasiloxane                                |
| 5.00  | Witconol APM           | PPG-3 myristyl ether                                                 |
| 5.00  | Softisan 154           | Hydrogenated palm oil                                                |
| 8.00  | Paraffin oil, thick-liquid | Mineral oil                                                      |
| 3.00  | Vaseline               | Petrolatum                                                           |
| 2%    | P18                    |                                                                      |
| 32.00 | Castor oil             | Castor (*Ricinus communis*) oil                                      |

(36)

|       |                          |                                                 |
|-------|--------------------------|-------------------------------------------------|
| 3.00  | Uvinul MC 80             | Ethylhexyl methoxycinnamate                     |
| 2.00  | Uvinul T 150             | Ethylhexyltriazone                              |
| 2.00  | Uvinul A Plus            | Diethylaminohydroxybenzoylhexyl benzoate        |
| 10.00 | Z-COTE MAX               | Zinc oxide (and) diphenylcaprylmethicone        |
| 12.00 | Beeswax 3044 PH          | Beeswax                                         |
| 3.00  | Vaseline                 | Petrolatum                                      |
| 8.00  | Candelilla wax LT 281 LJ | Candelilla (*Euphorbia cerifera*) wax           |
| 8.00  | Paraffin oil, thick-liquid | Mineral oil                                   |
| 5.00  | Tegin                    | Glyceryl stearate SE                            |
| 5.00  | Softisan 154             | Hydrogenated palm oil                           |
| 5.00  | Witconol APM             | PPG-3 myristyl ether                            |
| 5.00  | Dow Corning 345 Fluid    | Cyclopentasiloxane, cyclohexasiloxane           |
| 0.1%  | P18                      |                                                 |
| 28.90 | Castor oil               | Castor (*Ricinus communis*) oil                 |

(37)

|   |       |                           |                                                                       |
|---|-------|---------------------------|-----------------------------------------------------------------------|
|   | 5.00  | T-Lite SF                 | Titanium dioxide, aluminum hydrate, dimethicone/methicone copolymer   |
|   | 6.00  | Finsolv TN                | $C_{12-15}$-Alkyl benzoate                                            |
|   | 10.00 | Uvinul MC 80              | Ethylhexyl methoxycinnamate                                           |
|   | 6.00  | Miglyol 812               | Caprylic/capric triglyceride                                          |
|   | 5.00  | Arlacel P 135             | PEG-30 dipolyhydroxystearate                                          |
|   | 2.00  | Ganex V 216               | PVP/hexadecene copolymer                                              |
|   | 2.00  | Elfacos ST 9              | PEG-45/dodecyl glycol copolymer                                       |
| B | 3.00  | 1,2-Propylene glycol Care | Propylene glycol                                                      |
|   | 0.10  | Edeta BD                  | Disodium EDTA                                                         |
|   | 1.00  | Magnesium sulfate 7-hydrate | Magnesium sulfate                                                   |
|   | 59.40 | Water dem.                | Aqua dem.                                                             |
|   | 0.5%  | P18                       |                                                                       |
|   | q.s.  | Preservative              |                                                                       |

(38)

|   |      |               |                                                                                                                                                           |
|---|------|---------------|-----------------------------------------------------------------------------------------------------------------------------------------------------------|
| A | 4.00 | Dehymuls SBL  | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|   | 1.00 | Dehymuls PGPH | Polyglyceryl-2 dipolyhydroxystearate                                                                                                                      |
|   | 8.00 | Finsolv TN    | $C_{12-15}$-Alkyl benzoate                                                                                                                                |

-continued

|   |        |                            |                                                                 |
|---|--------|----------------------------|-----------------------------------------------------------------|
|   | 4.00   | Miglyol 812                | Caprylic/capric triglyceride                                    |
|   | 4.00   | Uvinul MC 80               | Ethylhexyl methoxycinnamate                                     |
|   | 2.00   | Uvinul N 539 T             | Octocrylene                                                     |
| B | 5.00   | Z-COTE MAX                 | Zinc oxide (and) diphenylcaprylmethicone                        |
| C | 3.00   | 1,2-Propylene glycol Care  | Propylene glycol                                                |
|   | 0.30   | Abiol                      | Imidazolidinylurea                                              |
|   | 1.00   | Magnesium sulfate 7-hydrate| Magnesium sulfate                                               |
|   | ad 100 | Water dem.                 | Aqua dem.                                                       |
|   | 1.5%   | P18                        |                                                                 |
| D | q.s.   | Preservative               |                                                                 |

(39)

|   |        |                            |                                                                 |
|---|--------|----------------------------|-----------------------------------------------------------------|
| A | 4.00   | Dehymuls SBL               | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|   | 1.00   | Dehymuls PGPH              | Polyglyceryl-2 dipolyhydroxystearate                            |
|   | 8.00   | Finsolv TN                 | $C_{12-15}$-Alkyl benzoate                                      |
|   | 4.00   | Miglyol 812                | Caprylic/capric triglyceride                                    |
|   | 4.00   | Uvinul MC 80               | Ethylhexyl methoxycinnamate                                     |
|   | 2.00   | Uvinul N 539 T             | Octocrylene                                                     |
| B | 5.00   | T-Lite SF-S                | Titanium dioxide, silicon hydrate, aluminum hydrate, methicone/dimethicone copolymer |
| C | 3.00   | 1,2-Propylene glycol Care  | Propylene glycol                                                |
|   | 0.30   | Abiol                      | Imidazolidinylurea                                              |
|   | 1.00   | Magnesium sulfate 7-hydrate| Magnesium sulfate                                               |
|   | 1.0%   | P18                        |                                                                 |
|   | ad 100 | Water dem.                 | Aqua dem.                                                       |
| D | q.s.   | Preservative               |                                                                 |

(40)

|   |        |                            |                                                                 |
|---|--------|----------------------------|-----------------------------------------------------------------|
| A | 4.00   | Dehymuls SBL               | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|   | 1.00   | Dehymuls PGPH              | Polyglyceryl-2 dipolyhydroxystearate                            |
|   | 8.00   | Finsolv TN                 | $C_{12-15}$-Alkyl benzoate                                      |
|   | 4.00   | Miglyol 812                | Caprylic/capric triglyceride                                    |
|   | 8.00   | Uvinul A Plus B            | Ethylhexyl methoxycinnamate and diethylaminohydroxybenzoylhexyl benzoate |
|   | 2.00   | Uvinul N 539 T             | Octocrylene                                                     |
| B | 5.00   | Z-COTE MAX                 | Zinc oxide (and) diphenylcaprylmethicone                        |
| C | 3.00   | 1,2-Propylene glycol Care  | Propylene glycol                                                |
|   | 0.30   | Abiol                      | Imidazolidinylurea                                              |
|   | 1.00   | Magnesium sulfate 7-hydrate| Magnesium sulfate                                               |
|   | 0.1%   | P18                        |                                                                 |
|   | ad 100 | Water dem.                 | Aqua dem.                                                       |
|   | q.s.   | Preservative               |                                                                 |

(41)

|   |      |                |                                                                 |
|---|------|----------------|-----------------------------------------------------------------|
| A | 4.00 | Dehymuls SBL   | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|   | 1.00 | Dehymuls PGPH  | Polyglyceryl-2 dipolyhydroxystearate                            |
|   | 8.00 | Finsolv TN     | $C_{12-15}$-Alkyl benzoate                                      |
|   | 4.00 | Miglyol 812    | Caprylic/capric triglyceride                                    |
|   | 8.00 | Uvinul A Plus B| Ethylhexyl methoxycinnamate and diethylaminohydroxybenzoylhexyl benzoate |

|   |       | Uvinul N 539 T | Octocrylene |
|---|-------|----------------|-------------|
|   | 2.00  |                |             |
| B | 5.00  | T-Lite SF      | Titanium dioxide, aluminum hydrate, dimethicone/methicone copolymer |
| C | 3.00  | 1,2-Propylene glycol Care | Propylene glycol |
|   | 0.30  | Abiol          | Imidazolidinylurea |
|   | 1.00  | Magnesium sulfate 7-hydrate | Magnesium sulfate |
|   | ad 100 | Water dem.    | Aqua dem. |
|   | 0.2%  | P18            |             |
|   | q.s.  | Preservative   |             |

(42)

| A | 4.00  | Dehymuls SBL   | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|---|-------|----------------|---|
|   | 1.00  | Dehymuls PGPH  | Polyglyceryl-2 dipolyhydroxystearate |
|   | 8.00  | Finsolv TN     | $C_{12-15}$-Alkyl benzoate |
|   | 4.00  | Miglyol 812    | Caprylic/capric triglyceride |
|   | 8.00  | Uvinul A Plus B | Ethylhexyl methoxycinnamate and diethylaminohydroxybenzoylhexyl benzoate |
|   | 2.00  | Uvinul N 539 T | Octocrylene |
| B | 5.00  | T-Lite SF-S    | Titanium dioxide, silicon hydrate, aluminum hydrate, methicone/dimethicone copolymer |
| C | 3.00  | 1,2-Propylene glycol Care | Propylene glycol |
|   | 0.30  | Abiol          | Imidazolidinylurea |
|   | 1.00  | Magnesium sulfate 7-hydrate | Magnesium sulfate |
|   | 0.5%  | P18            |   |
|   | ad 100 | Water dem.    | Aqua dem. |
|   | q.s.  | Preservative   |   |

(43)

| A | 4.00  | Dehymuls SBL   | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|---|-------|----------------|---|
|   | 1.00  | Dehymuls PGPH  | Polyglyceryl-2 dipolyhydroxystearate |
|   | 8.00  | Finsolv TN     | $C_{12-15}$-Alkyl benzoate |
|   | 4.00  | Miglyol 812    | Caprylic/capric triglyceride |
|   | 7.00  | Uvinul MC 80   | Ethylhexyl methoxycinnamate |
|   | 2.00  | Mexoryl XL     | Drometrizole trisiloxane |
| B | 5.00  | Z-COTE MAX     | Titanium dioxide, aluminum hydrate, dimethicone/methicone copolymer |
| C | 3.00  | 1,2-Propylene glycol Care | Propylene glycol |
|   | 0.30  | Abiol          | Imidazolidinylurea |
|   | 1.00  | Magnesium sulfate 7-hydrate | Magnesium sulfate |
|   | ad 100 | Water dem.    | Aqua dem. |
|   | 0.01% | P18            |   |
|   | q.s.  | Preservative   |   |

(44)

| A | 7.50  | Uvinul MC 80   | Ethylhexyl methoxycinnamate |
|---|-------|----------------|---|
|   | 3.00  | Uvinul N 539 T | Octocrylene |
|   | 2.00  | Uvinul A Plus  | Diethylaminohydroxybenzoylhexyl benzoate |
|   | 1.00  | Cremophor CO 40 | PEG-40 hydrogenated castor oil |
|   | 10.00 | Miglyol 812    | Caprylic/capric triglyceride |
|   | 1.50  | Dow Corning 345 Fluid | Cyclopentasiloxane, cyclohexasiloxane |
| B | 3.50  | Luvigel EM     | Caprylic/capric triglyceride, sodium acrylate copolymer |
| C | 46.00 | Water dem.     | Aqua dem. |
| D | 5.00  | 1,2-Propylene glycol Care | Propylene glycol |

-continued

|   | 0.50  | Cremophor A 25 | Ceteareth-25 |
|---|-------|----------------|---|
|   | 0.05% | P18            |   |
|   | 20.00 | Ethanol 96%    | Alcohol |

(45)

| A | 1.00  | Uvinul A Plus  | Diethylaminohydroxybenzoylhexyl benzoate |
|---|-------|----------------|---|
|   | 1.00  | Tinosorb S     | Bisethylhexyloxyphenol methoxyphenyltriazine |
|   | 3.00  | Uvinul MC 80   | Ethylhexyl methoxycinnamate |

-continued

|   |      |                    |                                                               |
|---|------|--------------------|---------------------------------------------------------------|
|   | 8.00 | Miglyol 812        | Caprylic/capric triglyceride                                  |
|   | 1.50 | Dow Corning 350 Fluid | Dimethicone                                                |
|   | 3.00 | Z-COTE MAX         | Titanium dioxide, aluminum hydrate, dimethicone/methicone copolymer |
|   | 3.00 | Finsolv TN         | C$_{12-15}$-Alkyl benzoate                                    |
|   | 1.00 | Cremophor CO 40    | PEG-40 hydrogenated castor oil                                |
| B | 2.00 | Luvigel EM         | Caprylic/capric triglyceride, sodium acrylate copolymer       |
| C | 54.80| Water dem.         | Aqua dem.                                                     |
| D | 15.00| Ethanol 96%        | Alcohol                                                       |
|   | 5.00 | 1,2-Propylene glycol Care | Propylene glycol                                       |
|   | 0.50 | Cremophor A 25     | Ceteareth-25                                                  |
|   | 1.0% | P18                |                                                               |
|   | 1.00 | Vitamin E acetate  | Tocopheryl acetate                                            |
|   | 0.20 | Bisabolol rac.     | Bisabolol                                                     |

(46)

|   |      |                  |                                                                                                                                                     |
|---|------|------------------|-----------------------------------------------------------------------------------------------------------------------------------------------------|
| A | 4.00 | Dehymuls SBL     | Polyglyceryl-2 dipolyhydroxystearate, dicaprylyl ether, cocoglycerides, sorbitan sesquioleate, Cera alba, aluminum stearate, dicocoylpentaerythrityldistearyl citrate |
|   | 1.00 | Dehymuls PGPH    | Polyglyceryl-2 dipolyhydroxystearate                                                                                                                |
|   | 6.00 | Finsolv TN       | C$_{12-15}$-Alkyl benzoate                                                                                                                          |
|   | 6.00 | Miglyol 812      | Caprylic/capric triglyceride                                                                                                                        |
|   | 5.00 | Uvinul MC 80     | Ethylhexyl methoxycinnamate                                                                                                                         |
|   | 3.00 | Neoheliopan HMS  | Homosalate                                                                                                                                          |
| B | 5.00 | Z-COTE MAX       | Zinc oxide (and) diphenylcaprylmethicone                                                                                                            |
| C | 3.00 | 1,2-Propylene glycol Care | Propylene glycol                                                                                                                           |
|   | 0.30 | Chemag 2000      | Imidazolidinylurea                                                                                                                                  |
|   | 1.00 | Magnesium sulfate 7-hydrate | Magnesium sulfate                                                                                                                         |
|   | 65.10| Water dem.       | Aqua dem.                                                                                                                                           |
|   | 0.1% | P18              |                                                                                                                                                     |
|   | q.s. | Preservative     |                                                                                                                                                     |

(47)

|   |       |                    |                                                                 |
|---|-------|--------------------|-----------------------------------------------------------------|
| A | 4.00  | Tego Care 450      | Polyglyceryl-3 methylglucose distearate                         |
|   | 4.50  | Uvinul MC 80       | Ethylhexyl methoxycinnamate                                     |
|   | 3.00  | Uvinul N 539 T     | Octocrylene                                                     |
|   | 2.00  | Uvinul T 150       | Ethylhexyltriazone                                              |
|   | 0.50  | Vitamin E acetate  | Tocopheryl acetate                                              |
| B | 5.00  | Isohexadecane      | Isohexadecane                                                   |
|   | 5.00  | Cosmacol EMI       | Di-C$_{12-13}$-alkyl malate                                     |
|   | 3.50  | Cetiol SN          | Cetearyl isononanoate                                           |
|   | 1.00  | Ganex V-220        | VP/eicosene copolymer                                           |
|   | 5.00  | T-Lite SF          | Titanium dioxide, aluminum hydrate, dimethicone/methicone copolymer |
| C | 60.00 | Water dem.         | Water                                                           |
|   | 5.00  | Glycerol 87%       | Glycerol                                                        |
|   | 1.00  | Lanette E          | Sodium cetearyl sulfate                                         |
|   | 0.30  | Keltrol            | Xanthan gum                                                     |
|   | 0.2%  | P18                |                                                                 |
| D | q.s.  | Preservative       |                                                                 |

(48)

|   |      |                    |                                         |
|---|------|--------------------|-----------------------------------------|
| A | 4.00 | Tego Care 450      | Polyglyceryl-3 methylglucose distearate |
|   | 4.50 | Uvinul MC 80       | Ethylhexyl methoxycinnamate             |
|   | 3.00 | Uvinul N 539 T     | Octocrylene                             |
|   | 2.00 | Neoheliopan HMS    | Homosalate                              |
|   | 0.50 | Vitamin E acetate  | Tocopheryl acetate                      |
| B | 5.00 | Isohexadecane      | Isohexadecane                           |
|   | 5.00 | Cosmacol EMI       | Di-C$_{12-13}$-alkyl malate             |
|   | 3.50 | Cetiol SN          | Cetearyl isononanoate                   |
|   | 1.00 | Ganex V-220        | VP/eicosene copolymer                   |
|   | 5.00 | T-Lite SF          | Titanium dioxide, aluminum hydrate, dimethicone/methicone copolymer |
| C | 59.20| Water dem.         | Aqua dem.                               |
|   | 5.00 | Glycerol 87%       | Glycerol                                |
|   | 1.00 | Lanette E          | Sodium cetearyl sulfate                 |
|   | 0.30 | Keltrol            | Xanthan gum                             |
|   | 1.0% | P18                |                                         |
| D | q.s. | Preservative       |                                         |

(49)

|   |      |                    |                                         |
|---|------|--------------------|-----------------------------------------|
| A | 4.00 | Tego Care 450      | Polyglyceryl-3 methylglucose distearate |
|   | 4.50 | Uvinul MC 80       | Ethylhexyl methoxycinnamate             |
|   | 3.00 | Neoheliopan OS     | Octisalate                              |
|   | 2.00 | Neoheliopan HMS    | Homosalate                              |
|   | 0.50 | Vitamin E acetate  | Tocopheryl acetate                      |
| B | 5.00 | Isohexadecane      | Isohexadecane                           |
|   | 5.00 | Cosmacol EMI       | Di-C$_{12-13}$-alkyl malate             |
|   | 3.50 | Cetiol SN          | Cetearyl isononanoate                   |
|   | 1.00 | Ganex V-220        | VP/eicosene copolymer                   |
|   | 5.00 | Z-COTE MAX         | Zinc oxide (and) diphenylcaprylmethicone|
| C | 60.15| Water dem.         | Aqua dem                                |
|   | 5.00 | Glycerol 87%       | Glycerol                                |
|   | 1.00 | Lanette E          | Sodium cetearyl sulfate                 |
|   | 0.30 | Keltrol            | Xanthan gum                             |
|   | 0.05%| P18                |                                         |
| D | q.s. | Preservative       |                                         |

(50)

|   |      |                    |                                         |
|---|------|--------------------|-----------------------------------------|
| A | 4.00 | Tego Care 450      | Polyglyceryl-3 methylglucose distearate |
|   | 4.50 | Uvinul N 539 T     | Octocrylene                             |
|   | 3.00 | Neoheliopan OS     | Octisalate                              |
|   | 2.00 | Neoheliopan HMS    | Homosalate                              |
|   | 0.50 | Vitamin E acetate  | Tocopheryl acetate                      |
| B | 5.00 | Isohexadecane      | Isohexadecane                           |
|   | 5.00 | Cosmacol EMI       | Di-C$_{12-13}$-alkyl malate             |
|   | 3.50 | Cetiol SN          | Cetearyl isononanoate                   |
|   | 1.00 | Ganex V-220        | VP/eicosene copolymer                   |
|   | 5.00 | Z-COTE MAX         | Zinc oxide (and) diphenylcaprylmethicone|
| C | 60.19| Water dem.         | Aqua dem.                               |
|   | 5.00 | Glycerol 87%       | Glycerol                                |
|   | 1.00 | Lanette E          | Sodium cetearyl sulfate                 |

|   |   |   |   |
|---|---|---|---|
|   | 0.30 | Keltrol | Xanthan gum |
|   | 0.01% | P18 |   |
| D | q.s. | Preservative |   |

(51)

|   |   |   |   |
|---|---|---|---|
| A | 4.00 | Tego Care 450 | Polyglyceryl-3 methylglucose distearate |
|   | 4.50 | Uvinul N 539 T | Octocrylene |
|   | 3.00 | Neoheliopan OS | Octisalate |
|   | 2.00 | Neoheliopan HMS | Homosalate |
|   | 0.50 | Vitamin E acetate | Tocopheryl acetate |
| B | 5.00 | Isohexadecane | Isohexadecane |
|   | 5.00 | Cosmacol EMI | Di-$C_{12-13}$-alkyl malate |
|   | 3.50 | Cetiol SN | Cetearyl isononanoate |
|   | 1.00 | Ganex V-220 | VP/eicosene copolymer |
|   | 5.00 | T-Lite SF-S | Titanium dioxide, silicon hydrate, aluminum hydrate, methicone/dimethicone copolymer |
| C | 59.20 | Water dem. | Aqua dem. |
|   | 5.00 | Glycerol 87% | Glycerol |
|   | 1.00 | Lanette E | Sodium cetearyl sulfate |
|   | 0.30 | Keltrol | Xanthan gum |
|   | 1.0% | P18 |   |
| D | q.s. | Preservative |   |

(52)

|   |   |   |   |
|---|---|---|---|
| A | 8.00 | Cetiol B | Dibutyl adipate |
|   | 8.00 | Finsolv TN | $C_{12-15}$-Alkyl benzoate |
|   | 12.00 | Myritol 331 | Cocoglycerides |
|   | 1.00 | Lanette E | Sodium cetearyl sulfate |
|   | 4.00 | Eumulgin VL 75 | Lauryl glucoside, polyglyceryl-2 dipolyhydroxystearate, glycerol |
|   | 2.00 | Lanette O | Cetearyl alcohol |
|   | 3.00 | Tinosorb S | Bisethylhexyloxyphenol methoxyphenyltriazine |
|   | 1.00 | Vitamin E acetate | Tocopheryl acetate |
| B | 4.00 | Z-COTE MAX | Zinc oxide (and) diphenylcaprylmethicone |
| C | 3.00 | Glycerol 87% | Glycerol |
|   | 0.05 | Edeta BD | Disodium EDTA |
|   | 0.20 | Allantoin | Allantoin |
|   | 0.30 | Keltrol | Xanthan gum |
|   | 1.50 | Veegum Ultra | Magnesium aluminum silicate |
|   | 49.45 | Water dem. | Aqua dem. |
|   | 1.0% | P18 |   |
| D | q.s. | Preservative |   |

(53)

|   |   |   |   |
|---|---|---|---|
| A | 8.00 | Cetiol B | Dibutyl adipate |
|   | 8.00 | Finsolv TN | $C_{12-15}$-Alkyl benzoate |
|   | 12.00 | Myritol 331 | Cocoglycerides |
|   | 1.00 | Lanette E | Sodium cetearyl sulfate |
|   | 4.00 | Eumulgin VL 75 | Laurylglucosid, polyglyceryl-2 dipolyhydroxystearate, glycerol |
|   | 2.00 | Lanette O | Cetearyl alcohol |
|   | 3.00 | Tinosorb S | Bisethylhexyloxyphenol methoxyphenyltriazine |
|   | 1.00 | Vitamin E acetate | Tocopheryl acetate |
| B | 4.00 | T-Lite SF | Titanium dioxide, aluminum hydrate, dimethicone/methicone copolymer |
| C | 3.00 | Glycerol 87% | Glycerol |
|   | 0.05 | Edeta BD | Disodium EDTA |
|   | 0.20 | Allantoin | Allantoin |
|   | 0.30 | Keltrol | Xanthan gum |
|   | 1.50 | Veegum Ultra | Magnesium aluminum silicate |
|   | 50.25 | Water dem. | Aqua dem. |
| D | 0.50 | Citric acid | Citric acid |
|   | q.s. | Perfume oil |   |
|   | 0.2% | P18 |   |
|   | q.s. | Preservative |   |

(54)

|   |   |   |   |
|---|---|---|---|
| A | 5.00 | Cosmacol EMI | Di-$C_{12-13}$-alkyl malate |
|   | 4.50 | Uvinul MC 80 | Ethylhexyl methoxycinnamate |
|   | 3.00 | Uvinul N 539 T | Octocrylene |
|   | 2.00 | Uvinul T 150 | Ethylhexyltriazone |
| B | 4.00 | Tego Care 450 | Polyglyceryl-3 methylglucose distearate |
|   | 5.00 | Isohexadecane | Isohexadecane |
|   | 3.50 | Cetiol SN | Cetearyl isononanoate |
|   | 0.50 | Vitamin E acetate | Tocopheryl acetate |
|   | 1.00 | Ganex V-220 | VP/eicosene copolymer |
|   | 2.50 | T-Lite SF | Titanium dioxide, aluminum hydrate, dimethicone/methicone copolymer |
| C | 5.00 | Glycerol 87% | Glycerol |
|   | 2.00 | Lanette E | Sodium cetearyl sulfate |
|   | 0.30 | Keltrol | Xanthan gum |
|   | 1.00 | Pationic 138 C | Sodium lauroyl lactylate |
|   | 1.00 | Pationic SSL | Sodium stearoyl lactylate |
|   | 42.00 | Water dem. | Aqua dem. |
| D | 5.00 | Eusolex 232 | Phenylbenzimidazolesulfonic acid |
|   | 10.00 | Water dem. | Aqua dem |
| E | 0.70 | Sodium hydroxide | Sodium hydroxide |
|   | 1.0% | P18 |   |
|   | q.s. | Preservative |   |

(55)

|   |   |   |   |
|---|---|---|---|
| A | 5.00 | Cosmacol EMI | Di-$C_{12-13}$Alkyl malate |
|   | 4.50 | Uvinul MC 80 | Ethylhexyl methoxycinnamate |
|   | 3.00 | Uvinul N 539 T | Octocrylene |
|   | 2.00 | Uvinul A Plus | Diethylaminohydroxybenzoylhexyl benzoate |
| B | 4.00 | Tego Care 450 | Polyglyceryl-3 methylglucose distearate |
|   | 5.00 | Isohexadecane | Isohexadecane |
|   | 3.50 | Cetiol SN | Cetearyl isononanoate |
|   | 0.50 | Vitamin E acetate | Tocopheryl acetate |
|   | 1.00 | Ganex V-220 | VP/eicosene copolymer |
|   | 2.50 | T-Lite SF | Titanium dioxide, aluminum hydrate, dimethicone/methicone copolymer |
| C | 5.00 | Glycerol 87% | Glycerol |
|   | 2.00 | Lanette E | Sodium cetearyl sulfate |
|   | 0.30 | Keltrol | Xanthan gum |
|   | 1.00 | Pationic 138 C | Sodium lauroyl lactylate |
|   | 1.00 | Pationic SSL | Sodium stearoyl lactylate |
|   | 41.00 | Water dem. | Aqua dem |
| D | 5.00 | Eusolex 232 | Phenylbenzimidazolesulfonic acid |
|   | 2.0% | P18 |   |
|   | 10.00 | Water dem. | Aqua dem |
| E | 0.70 | Sodium hydroxide | Sodium hydroxid |
|   | q.s. | Preservative |   |

(56)

|   |   |   |   |
|---|---|---|---|
| A | 5.00 | Cosmacol EMI | Di-$C_{12-13}$Alkyl malate |
|   | 4.50 | Uvinul MC 80 | Ethylhexyl methoxycinnamate |
|   | 3.00 | Uvinul N 539 T | Octocrylene |
|   | 2.00 | Uvinul A Plus | Diethylaminohydroxybenzoylhexyl benzoate |
| B | 4.00 | Tego Care 450 | Polyglyceryl-3 methylglucose distearate |
|   | 5.00 | Isohexadecane | Isohexadecane |
|   | 3.50 | Cetiol SN | Cetearyl isononanoate |
|   | 0.50 | Vitamin E acetate | Tocopheryl acetate |
|   | 1.00 | Ganex V-220 | VP/eicosene copolymer |
|   | 2.50 | Z-COTE MAX | Zinc oxide (and) diphenylcaprylmethicone |

-continued

| | | | |
|---|---|---|---|
| C | 5.00 | Glycerol 87% | Glycerol |
| | 2.00 | Lanette E | Sodium cetearyl sulfate |
| | 0.30 | Keltrol | Xanthan gum |
| | 1.00 | Pationic 138 C | Sodium lauroyl lactylate |
| | 1.00 | Pationic SSL | Sodium stearoyl lactylate |
| | 42.50 | Water dem. | Aqua dem |
| D | 5.00 | Eusolex 232 | Phenylbenzimidazolesulfonic acid |
| | 0.5% | P18 | |
| | 10.00 | Water dem. | Aqua dem |
| E | 0.70 | Sodium hydroxide | Sodium hydroxide |
| | q.s. | Preservative | |

(57)

| | | | |
|---|---|---|---|
| A | 5.00 | Cosmacol EMI | Di-$C_{12-13}$Alkyl malate |
| | 7.50 | Uvinul N 539 T | Octocrylene |
| | 2.00 | Mexoryl XL | Drometrizole trisiloxane |
| B | 4.00 | Tego Care 450 | Polyglyceryl-3 methylglucose distearate |
| | 5.00 | Isohexadecane | Isohexadecane |
| | 3.50 | Cetiol SN | Cetearyl isononanoate |
| | 0.50 | Vitamin E acetate | Tocopheryl acetate |
| | 1.00 | Ganex V-220 | VP/eicosene copolymer |
| | 5.00 | Z-COTE MAX | Zinc oxide (and) diphenylcaprylmethicone |
| C | 5.00 | Glycerol 87% | Glycerol |
| | 2.00 | Lanette E | Sodium cetearyl sulfate |
| | 0.30 | Keltrol | Xanthan gum |
| | 1.00 | Pationic 138 C | Sodium lauroyl lactylate |
| | 1.00 | Pationic SSL | Sodium stearoyl lactylate |
| | 40.50 | Water dem. | Aqua dem |
| D | 5.00 | Eusolex 232 | Phenylbenzimidazolesulfonic acid |
| | 1.0% | P18 | |
| | 10.00 | Water dem. | Aqua dem |
| E | 0.70 | Sodium hydroxide | Sodium hydroxide |
| | q.s. | Preservative | |

(58)

| | | | |
|---|---|---|---|
| A | 5.00 | Cosmacol EMI | Di-$C_{12-13}$Alkyl malate |
| | 5.50 | Uvinul N 539 T | Octocrylene |
| | 2.00 | Uvinul A Plus | Diethylaminohydrobenzoylhexyl benzoate |
| | 2.00 | Mexoryl XL | Drometrizole trisiloxane |
| B | 4.00 | Tego Care 450 | Polyglyceryl-3 methylglucose distearate |
| | 5.00 | Isohexadecane | Isohexadecane |
| | 3.50 | Cetiol SN | Cetearyl isononanoate |
| | 0.50 | Vitamin E acetate | Tocopheryl acetate |
| | 1.00 | Ganex V-220 | VP/eicosene copolymer |
| | 5.00 | Z-COTE MAX | Zinc oxide (and) diphenylcaprylmethicone |
| C | 5.00 | Glycerol 87% | Glycerol |
| | 2.00 | Lanette E | Sodium cetearyl sulfate |
| | 0.30 | Keltrol | Xanthan gum |
| | 1.00 | Pationic 138 C | Sodium lauroyl lactylate |
| | 1.00 | Pationic SSL | Sodium stearoyl lactylate |
| | 41.50 | Water dem. | Aqua dem |
| D | 5.00 | Eusolex 232 | Phenylbenzimidazolesulfonic acid |
| | 0.5% | P18 | |
| | 9.50 | Water dem. | Aqua dem |
| E | 0.70 | Sodium hydroxide | Sodium hydroxide |
| | q.s. | Preservative | |

(59)

| | | | |
|---|---|---|---|
| A | 5.00 | Cosmacol EMI | Di-$C_{12-13}$Alkyl malate |
| | 5.50 | Uvinul N 539 T | Octocrylene |
| | 2.00 | Uvinul A Plus | Diethylaminohydrobenzoylhexyl benzoate |
| | 2.00 | Mexoryl XL | Drometrizole trisiloxane |

-continued

| | | | |
|---|---|---|---|
| B | 4.00 | Tego Care 450 | Polyglyceryl-3 methylglucose distearate |
| | 5.00 | Isohexadecane | Isohexadecane |
| | 3.50 | Cetiol SN | Cetearyl isononanoate |
| | 0.50 | Vitamin E acetate | Tocopheryl acetate |
| | 1.00 | Ganex V-220 | VP/eicosene copolymer |
| | 5.00 | T-Lite SF-S | Titanium dioxide, silicon hydrate, aluminum hydrate, methicone/dimethicone copolymer |
| C | 5.00 | Glycerol 87% | Glycerol |
| | 2.00 | Lanette E | Sodium cetearyl sulfate |
| | 0.30 | Keltrol | Xanthan gum |
| | 1.00 | Pationic 138 C | Sodium lauroyl lactylate |
| | 1.00 | Pationic SSL | Sodium stearoyl lactylate |
| | 40.50 | Water dem. | Aqua dem |
| D | 5.00 | Eusolex 232 | Phenylbenzimidazolesulfonic acid |
| | 1.0% | P18 | |
| | 10.00 | Water dem. | Aqua dem |
| E | 0.70 | Sodium hydroxide | Sodium hydroxide |
| | q.s. | Preservative | |

(60)

| | | | |
|---|---|---|---|
| A | 8.00 | Cetiol B | Dibutyl adipate |
| | 8.00 | Finsolv TN | $C_{12-15}$-Alkyl benzoate |
| | 10.00 | Myritol 331 | Cocoglycerides |
| | 1.00 | Lanette E | Sodium cetearyl sulfate |
| | 4.00 | Eumulgin VL 75 | Lauryl glucoside, polyglyceryl-2 dipolyhydroxystearate, glycerol |
| | 2.00 | Lanette O | Cetearyl alcohol |
| | 1.00 | Tinosorb S | Bisethylhexyloxyphenol methoxyphenyltriazine |
| | 1.00 | Uvinul T 150 | Ethylhexyltriazone |
| | 1.00 | Vitamin E acetate | Tocopheryl acetate |
| B | 5.00 | T-Lite SF | Titanium dioxide, aluminum hydrate, dimethicone/methicone copolymer |
| C | 3.00 | Glycerol 87% | Glycerol |
| | 0.05 | Edeta BD | Disodium EDTA |
| | 0.20 | Allantoin | Allantoin |
| | 0.30 | Keltrol | Xanthan gum |
| | 2.0% | P18 | |
| | 1.50 | Veegum Ultra | Magnesium aluminum silicate |
| | ad 100 | Water dem. | Aqua dem |
| D | q.s. | Perfume oil | |
| | q.s. | Preservative | |

(61)

| | | | |
|---|---|---|---|
| A | 8.00 | Cetiol B | Dibutyl adipate |
| | 8.00 | Finsolv TN | $C_{12-15}$-Alkyl benzoate |
| | 10.00 | Myritol 331 | Cocoglycerides |
| | 1.00 | Lanette E | Sodium cetearyl sulfate |
| | 4.00 | Eumulgin VL 75 | Lauryl glucoside, polyglyceryl-2 dipolyhydroxystearate, glycerol |
| | 2.00 | Lanette O | Cetearyl alcohol |
| | 1.00 | Tinosorb S | Bisethylhexyloxyphenol methoxyphenyltriazine |
| | 1.00 | Uvinul T 150 | Ethylhexyltriazone |
| | 1.00 | Vitamin E acetate | Tocopheryl acetate |
| B | 5.00 | Z-COTE MAX | Zinc oxide (and) diphenylcaprylmethicone |
| C | 3.00 | Glycerol 87% | Glycerol |
| | 0.05 | Edeta BD | Disodium EDTA |
| | 0.20 | Allantoin | Allantoin |
| | 0.30 | Keltrol | Xanthan gum |
| | 1.0% | P18 | |
| | 1.50 | Veegum Ultra | Magnesium aluminum silicate |
| | ad 100 | Water dem. | Aqua dem |
| D | q.s. | Perfume oil | |
| | q.s. | Preservative | |

(62)

| | | | |
|---|---|---|---|
| A | 3.00 | Glycerol 87% | Glycerol |
| | 0.20 | Edeta BD | Disodium EDTA |
| | 0.30 | Abiol | Imidazolidinylurea |
| | 1.00 | Plantacare 2000 | Decyl glucoside |
| | 0.30 | Keltrol T | Xanthan gum |
| | 57.00 | Water dem. | Aqua dem. |
| B | 5.00 | T-Lite SF-S | Titanium dioxide, silicon hydrate, aluminum hydrate, methicone/dimethicone copolymer |
| C | 7.50 | Uvinul MC 80 | Ethylhexyl methoxycinnamate |
| | 2.00 | Uvinul A Plus | Diethylaminohydroxybenzoylhexyl benzoate |
| | 2.00 | Dow Corning 345 Fluid | Cyclopentasiloxane, cyclohexasiloxane |
| | 3.50 | Cremophor A 6 | Ceteareth-6, stearyl alcohol |
| | 1.50 | Cremophor A 25 | Ceteareth-25 |
| | 0.50 | Beeswax 3044 PH | Beeswax |
| | 3.00 | Lanette O | Cetearyl alcohol |
| | 10.00 | Miglyol 812 | Caprylic/capric triglyceride |
| D | 1.00 | Vitamin E acetate | Tocopheryl acetate |
| | 2.0% | P18 | |
| | 0.20 | Bisabolol rac. | Bisabolol |

(63)

| | | | |
|---|---|---|---|
| A | 3.00 | Glycerol 87% | Glycerol |
| | 0.20 | Edeta BD | Disodium EDTA |
| | 0.30 | Abiol | Imidazolidinylurea |
| | 1.00 | Plantacare 2000 | Decyl glucoside |
| | 0.30 | Keltrol T | Xanthan gum |
| | 58.00 | Water dem. | Aqua dem. |
| B | 5.00 | Z-COTE MAX | Zinc oxide (and) diphenylcaprylmethicone |
| C | 7.50 | Uvinul MC 80 | Ethylhexyl methoxycinnamate |
| | 2.00 | Uvinul A Plus | Diethylaminohydroxybenzoylhexyl benzoate |
| | 2.00 | Dow Corning 345 Fluid | Cyclopentasiloxane, cyclohexasiloxane |
| | 3.50 | Cremophor A 6 | Ceteareth-6, stearyl alcohol |
| | 1.50 | Cremophor A 25 | Ceteareth-25 |
| | 0.50 | Beeswax 3044 PH | Beeswax |
| | 3.00 | Lanette O | Cetearyl alcohol |
| | 10.00 | Miglyol 812 | Caprylic/capric triglyceride |
| D | 1.00 | Vitamin E acetate | Tocopheryl acetate |
| | 1.0% | P18 | |
| | 0.20 | Bisabolol rac. | Bisabolol |

(64)

| | | | |
|---|---|---|---|
| A | 3.00 | Glycerol 87% | Glycerol |
| | 0.20 | Edeta BD | Disodium EDTA |
| | 0.30 | Abiol | Imidazolidinylurea |
| | 1.00 | Plantacare 2000 | Decyl glucoside |
| | 0.30 | Keltrol T | Xanthan gum |
| | 58.50 | Water dem. | Aqua dem. |
| B | 5.00 | T-Lite SF-S | Titanium dioxide, silicon hydrate, aluminum hydrate, methicone/dimethicone copolymer |
| C | 7.50 | Uvinul MC 80 | Ethylhexyl methoxycinnamate |
| | 5.00 | Uvinul N 539 T | Octocrylene |
| | 2.00 | Parsol 1789 | Butylmethoxydibenzoylmethane |
| | 2.00 | Dow Corning 345 Fluid | Cyclopentasiloxane, cyclohexasiloxane |
| | 3.50 | Cremophor A 6 | Ceteareth-6, stearyl alcohol |
| | 1.50 | Cremophor A 25 | Ceteareth-25 |
| | 0.50 | Beeswax 3044 PH | Beeswax |
| | 3.00 | Lanette O | Cetearyl alcohol |
| | 10.00 | Miglyol 812 | Caprylic/capric triglyceride |
| D | 1.00 | Vitamin E acetate | Tocopheryl acetate |
| | 0.5% | P18 | |
| | 0.20 | Bisabolol rac. | Bisabolol |

(65)

| | | | |
|---|---|---|---|
| A | 3.00 | Glycerol 87% | Glycerol |
| | 0.20 | Edeta BD | Disodium EDTA |
| | 0.30 | Abiol | Imidazolidinylurea |
| | 1.00 | Plantacare 2000 | Decyl glucoside |
| | 0.30 | Keltrol T | Xanthan gum |
| | 2.00 | Mexoryl SL | Terephthalidenedicamphorsulfonic acid |
| | 58.40 | Water dem. | Aqua dem. |
| B | 6.00 | T-Lite SF-S | Titanium dioxide, silicon hydrate, aluminum hydrate, methicone/dimethicone copolymer |
| C | 6.00 | Uvinul N 539 T | Octocrylene |
| | 2.00 | Parsol 1789 | Butylmethoxydibenzoylmethane |
| | 2.00 | Dow Corning 345 Fluid | Cyclopentasiloxane, cyclohexasiloxane |
| | 3.50 | Cremophor A 6 | Ceteareth-6, stearyl alcohol |
| | 1.50 | Cremophor A 25 | Ceteareth-25 |
| | 0.50 | Beeswax 3044 PH | Beeswax |
| | 3.00 | Lanette O | Cetearyl alcohol |
| | 10.00 | Miglyol 812 | Caprylic/capric triglyceride |
| D | 1.00 | Vitamin E acetate | Tocopheryl acetate |
| | 0.1% | P18 | |
| | 0.20 | Bisabolol rac. | Bisabolol |

(66)

| | | | |
|---|---|---|---|
| A | 3.00 | Glycerol 87% | Glycerol |
| | 0.20 | Edeta BD | Disodium EDTA |
| | 0.30 | Abiol | Imidazolidinylurea |
| | 1.00 | Plantacare 2000 | Decyl glucoside |
| | 0.30 | Keltrol T | Xanthan gum |
| | 2.00 | Mexoryl SL | Terephthalidenedicamphorsulfonic acid |
| | 58.45 | Water dem. | Aqua dem. |
| B | 6.00 | Z-COTE MAX | Zinc oxide (and) diphenylcaprylmethicone |
| | 6.00 | Uvinul N 539 T | Octocrylene |
| | 2.00 | Parsol 1789 | Butylmethoxydibenzoylmethane |
| | 2.00 | Dow Corning 345 Fluid | Cyclopentasiloxane, cyclohexasiloxane |
| | 3.50 | Cremophor A 6 | Ceteareth-6, stearyl alcohol |
| | 1.50 | Cremophor A 25 | Ceteareth-25 |
| | 0.50 | Beeswax 3044 PH | Beeswax |
| | 3.00 | Lanette O | Cetearyl alcohol |
| | 10.00 | Miglyol 812 | Caprylic/capric triglyceride |
| D | 1.00 | Vitamin E acetate | Tocopheryl acetate |
| | 0.05% | P18 | |
| | 0.20 | Bisabolol rac. | Bisabolol |

(67)

| | | | |
|---|---|---|---|
| A | 3.00 | Glycerol 87% | Glycerol |
| | 0.20 | Edeta BD | Disodium EDTA |
| | 0.30 | Abiol | Imidazolidinylurea |
| | 1.00 | Plantacare 2000 | Decyl glucoside |
| | 0.30 | Keltrol T | Xanthan gum |
| | 2.00 | Neoheliopan AP | Disodium phenyldibenzimidazoletetrasulfonate |
| | 57.50 | Water dem. | Aqua dem. |
| B | 6.00 | Z-COTE MAX | Zinc oxide (and) diphenylcaprylmethicone |
| | 6.00 | Uvinul N 539 T | Octocrylene |
| | 2.00 | Parsol 1789 | Butylmethoxydibenzoylmethane |
| | 2.00 | Dow Corning 345 Fluid | Cyclopentasiloxane, cyclohexasiloxane |
| | 3.50 | Cremophor A 6 | Ceteareth-6, stearyl alcohol |
| | 1.50 | Cremophor A 25 | Ceteareth-25 |
| | 0.50 | Beeswax 3044 PH | Beeswax |
| | 3.00 | Lanette O | Cetearyl alcohol |
| | 10.00 | Miglyol 812 | Caprylic/capric triglyceride |
| D | 1.00 | Vitamin E acetate | Tocopheryl acetate |
| | 1.0% | P18 | |
| | 0.20 | Bisabolol rac. | Bisabolol |

(68)

|   |       |                     |                                                                        |
|---|-------|---------------------|------------------------------------------------------------------------|
| A | 25.00 | Dow Corning 345 Fluid | Cyclopentasiloxane, cyclohexasiloxane                                |
|   | 20.00 | Dow Corning 245 Fluid | Cyclopentasiloxane                                                   |
|   | 8.00  | Uvinul MC 80        | Ethylhexyl methoxycinnamate                                            |
|   | 4.00  | Abil EM 90          | Cetyl-PEG-/PPG-10-/1-dimethicone                                       |
|   | 7.00  | T-Lite SF           | Titanium dioxide, aluminum hydrate, dimethicone/methicone copolymer    |
| B | 17.00 | Ethanol 95%         | Alcohol                                                                |
|   | 10.00 | Z-COTE MAX          | Zinc oxide (and) diphenylcaprylmethicone                               |
|   | 4.50  | Water dem.          | Aqua dem.                                                              |
|   | 3.00  | Glycerol 87%        | Glycerol                                                               |
|   | 0.5%  | P18                 |                                                                        |
|   | 1.00  | Talc                | Talc                                                                   |

(69)

|   |       |                     |                                                                                               |
|---|-------|---------------------|-----------------------------------------------------------------------------------------------|
| A | 25.00 | Dow Corning 345 Fluid | Cyclopentasiloxane, cyclohexasiloxane                                                       |
|   | 20.00 | Dow Corning 245 Fluid | Cyclopentasiloxane                                                                          |
|   | 8.00  | Uvinul MC 80        | Ethylhexyl methoxycinnamate                                                                   |
|   | 4.00  | Abil EM 90          | Cetyl-PEG-/PPG-10-/1-dimethicone                                                              |
|   | 7.00  | T-Lite SF-S         | Titanium dioxide, silicon hydrate, aluminum hydrate, methicone/dimethicone copolymer          |
| B | 17.00 | Ethanol 95%         | Alcohol                                                                                       |
|   | 9.99  | Z-COTE MAX          | Zinc oxide (and) diphenylcaprylmethicone                                                      |
|   | 5.00  | Water dem.          | Aqua dem.                                                                                     |
|   | 3.00  | Glycerol 87%        | Glycerol                                                                                      |
|   | 0.01% | P18                 |                                                                                               |
|   | 1.00  | Talc                | Talc                                                                                          |

(70)

|   |       |                     |                                                                     |
|---|-------|---------------------|---------------------------------------------------------------------|
| A | 20.00 | Dow Corning 345 Fluid | Cyclopentasiloxane, cyclohexasiloxane                             |
|   | 10.00 | Dow Corning 245 Fluid | Cyclopentasiloxane                                                |
|   | 7.50  | Uvinul MC 80        | Ethylhexyl methoxycinnamate                                         |
|   | 2.00  | Uvinul T 150        | Ethylhexyltriazone                                                  |
|   | 12.00 | Cosmacol EMI        | Di-$C_{12-13}$-alkyl malate                                         |
|   | 4.00  | Abil EM 90          | Cetyl-PEG-/PPG-10-/1-dimethicone                                    |
| B | 7.00  | T-Lite SF           | Titanium dioxide, aluminum hydrate, dimethicone/methicone copolymer |
| C | 15.00 | Ethanol 95%         | Alcohol                                                             |
|   | 10.00 | Z-COTE MAX          | Zinc oxide (and) diphenylcaprylmethicone                            |
|   | 3.00  | Glycerol 87%        | Glycerol                                                            |
|   | 1.5%  | P18                 |                                                                     |
|   | 8.00  | Water dem.          | Aqua dem.                                                           |

(71)

|   |       |                     |                                                                     |
|---|-------|---------------------|---------------------------------------------------------------------|
| A | 20.00 | Dow Corning 345 Fluid | Cyclopentasiloxane, cyclohexasiloxane                             |
|   | 10.00 | Dow Corning 245 Fluid | Cyclopentasiloxane                                                  |
|   | 7.50  | Uvinul MC 80        | Ethylhexyl methoxycinnamate                                         |
|   | 2.00  | Tinosorb S          | Bisethylhexyloxyphenol methoxyphenyltriazine                        |
|   | 12.00 | Cosmacol EMI        | Di-$C_{12-13}$-alkyl malate                                         |
|   | 4.00  | Abil EM 90          | Cetyl-PEG-/PPG-10-/1-dimethicone                                    |
| B | 7.00  | T-Lite SF           | Titanium dioxide, aluminum hydrate, dimethicone/methicone copolymer |
| C | 15.00 | Ethanol 95%         | Alcohol                                                             |
|   | 10.00 | Z-COTE MAX          | Zinc oxide (and) diphenylcaprylmethicone                            |
|   | 3.00  | Glycerol 87%        | Glycerol                                                            |
|   | 0.5%  | P18                 |                                                                     |
|   | 9.00  | Water dem.          | Aqua dem.                                                           |

(72)

|   |       |                 |                                                                                            |
|---|-------|-----------------|--------------------------------------------------------------------------------------------|
| A | 2.00  | Cremophor WO 7  | PEG-7-hydrogenated castor oil                                                              |
|   | 6.00  | Abil B 8839     | Cyclopentasiloxane, cyclohexasiloxane                                                      |
|   | 3.00  | T-Lite SF       | Titanium dioxide, aluminum hydrate, dimethicone/methicone copolymer                        |
|   | 4.00  | Isopropyl palmitate | Isopropyl palmitate                                                                    |
|   | 1.00  | Abil 350        | Dimethicone                                                                                |
| B | 7.00  | Uvinul MC 80    | Ethylhexyl methoxycinnamate                                                                |
|   | 1.00  | Uvinul T 150    | Ethylhexyltriazone                                                                         |
|   | 7.00  | Finsolv TN      | $C_{12-15}$-Alkyl benzoate                                                                 |
|   | 4.00  | Abil WE 09      | Polyglyceryl-4 isostearate, cetyl-PEG-/PPG-10-/1-dimethicone, hexyl laurate                |
| C | 0.50  | Sodium chloride | Sodium chloride                                                                            |
|   | 0.20  | Edeta BD        | Disodium EDTA                                                                              |
|   | 61.30 | Water dem.      | Aqua dem                                                                                   |
| D | 1.00  | Vitamin E acetate | Tocopheryl acetate                                                                       |
|   | 1.0%  | P18             |                                                                                            |
|   | q.s.  | Preservative    |                                                                                            |

(73)

|   |       |                 |                                                                                            |
|---|-------|-----------------|--------------------------------------------------------------------------------------------|
| A | 2.00  | Cremophor WO 7  | PEG-7-hydrogenated castor oil                                                              |
|   | 6.00  | Abil B 8839     | Cyclopentasiloxane, cyclohexasiloxane                                                      |
|   | 3.00  | Z-COTE MAX      | Zinc oxide (and) diphenylcaprylmethicone                                                   |
|   | 4.00  | Isopropyl palmitate | Isopropyl palmitate                                                                    |
|   | 1.00  | Abil 350        | Dimethicone                                                                                |
| B | 7.00  | Uvinul MC 80    | Ethylhexyl methoxycinnamate                                                                |
|   | 1.00  | Uvinul T 150    | Ethylhexyltriazone                                                                         |
|   | 7.00  | Finsolv TN      | $C_{12-15}$-Alkyl benzoate                                                                 |
|   | 4.00  | Abil WE 09      | Polyglyceryl-4 isostearate, cetyl-PEG-/PPG-10-/1-dimethicone, hexyl laurate                |
| C | 0.50  | Sodium chloride | Sodium chloride                                                                            |
|   | 0.20  | Edeta BD        | Disodium EDTA                                                                              |
|   | 62.20 | Water dem.      | Aqua dem                                                                                   |
| D | 1.00  | Vitamin E acetate | Tocopheryl acetate                                                                       |
|   | 0.1%  | P18             |                                                                                            |
|   | q.s.  | Preservative    |                                                                                            |

(74)

|   |       |                 |                                                                                            |
|---|-------|-----------------|--------------------------------------------------------------------------------------------|
| A | 2.00  | Cremophor WO 7  | PEG-7-hydrogenated castor oil                                                              |
|   | 6.00  | Abil B 8839     | Cyclopentasiloxane, cyclohexasiloxane                                                      |
|   | 3.00  | Z-COTE MAX      | Zinc oxide (and) diphenylcaprylmethicone                                                   |
|   | 4.00  | Isopropyl palmitate | Isopropyl palmitate                                                                    |
|   | 1.00  | Abil 350        | Dimethicone                                                                                |
| B | 7.00  | Uvinul MC 80    | Ethylhexyl methoxycinnamate                                                                |
|   | 1.00  | Tinosorb S      | Bisethylhexyloxyphenol methoxyphenyltriazine                                               |
|   | 7.00  | Finsolv TN      | $C_{12-15}$-Alkyl benzoate                                                                 |
|   | 4.00  | Abil WE 09      | Polyglyceryl-4 isostearate, cetyl-PEG-/PPG-10-/1-dimethicone, hexyl laurate                |
| C | 0.50  | Sodium chloride | Sodium chloride                                                                            |
|   | 0.20  | Edeta BD        | Disodium EDTA                                                                              |
|   | 60.30 | Water dem.      | Aqua dem                                                                                   |
| D | 1.00  | Vitamin E acetate | Tocopheryl acetate                                                                       |
|   | 2.0%  | P18             |                                                                                            |
|   | q.s.  | Preservative    |                                                                                            |

(75)

| | | | |
|---|---|---|---|
| A | 2.00 | Cremophor WO 7 | PEG-7-hydrogenated castor oil |
| | 6.00 | Abil B 8839 | Cyclopentasiloxane, cyclohexasiloxane |
| | 6.00 | Z-COTE MAX | Zinc oxide (and) diphenylcaprylmethicone |
| | 4.00 | Isopropyl palmitate | Isopropyl palmitate |
| | 1.00 | Abil 350 | Dimethicone |
| B | 4.00 | Uvinul N 539 T | Octocrylene |
| | 1.00 | Tinosorb S | Bisethylhexyloxyphenol methoxyphenyltriazine |
| | 7.00 | Finsolv TN | $C_{12-15}$-Alkyl benzoate |
| | 4.00 | Abil WE 09 | Polyglyceryl-4 isostearate, cetyl-PEG-/PPG-10-/1-dimethicone, hexyl laurate |
| C | 0.50 | Sodium chloride | Sodium chloride |
| | 0.20 | Edeta BD | Disodium EDTA |
| | 62.10 | Water dem. | Aqua dem |
| D | 1.00 | Vitamin E acetate | Tocopheryl acetate |
| | 0.2% | P18 | |
| | q.s. | Preservative | |

(76)

| | | | |
|---|---|---|---|
| A | 2.00 | Cremophor WO 7 | PEG-7-hydrogenated castor oil |
| | 6.00 | Abil B 8839 | Cyclopentasiloxane, cyclohexasiloxane |
| | 6.00 | Z-COTE MAX | Zinc oxide (and) diphenylcaprylmethicone |
| | 4.00 | Isopropyl palmitate | Isopropyl palmitate |
| | 1.00 | Abil 350 | Dimethicone |
| B | 3.00 | Uvinul N 539 T | Octocrylene |
| | 1.00 | Mexoryl XL | Drometrizole trisiloxane |
| | 1.00 | Tinosorb S | Bisethylhexyloxyphenol methoxyphenyltriazine |
| | 7.00 | Finsolv TN | $C_{12-15}$-Alkyl benzoate |
| | 4.00 | Abil WE 09 | Polyglyceryl-4 isostearate, cetyl-PEG-/PPG-10-/1-dimethicone, hexyl laurate |
| C | 0.50 | Sodium chloride | Sodium chloride |
| | 0.20 | Edeta BD | Disodium EDTA |
| | 1.0% | P18 | |
| | 61.30 | Water dem. | Aqua dem |
| D | 1.00 | Vitamin E acetate | Tocopheryl acetate |
| | q.s. | Preservative | |

(77)

| | | | |
|---|---|---|---|
| A | 2.00 | Cremophor WO 7 | PEG-7-hydrogenated castor oil |
| | 6.00 | Abil B 8839 | Cyclopentasiloxane, cyclohexasiloxane |
| | 6.00 | T-Lite SF-S | Titanium dioxide, silicon hydrate, aluminum hydrate, methicone/dimethicone copolymer |
| | 4.00 | Isopropyl palmitate | Isopropyl palmitate |
| | 1.00 | Abil 350 | Dimethicone |
| B | 3.00 | Uvinul N 539 T | Octocrylene |
| | 1.00 | Mexoryl XL | Drometrizole trisiloxane |
| | 1.00 | Tinosorb S | Bisethylhexyloxyphenol methoxyphenyltriazine |
| | 7.00 | Finsolv TN | $C_{12-15}$-Alkyl benzoate |
| | 4.00 | Abil WE 09 | Polyglyceryl-4 isostearate, cetyl-PEG-/PPG-10-/1-dimethicone, hexyl laurate |
| C | 0.50 | Sodium chloride | Sodium chloride |
| | 0.20 | Edeta BD | Disodium EDTA |
| | 61.80 | Water dem. | Aqua dem |
| D | 1.00 | Vitamin E acetate | Tocopheryl acetate |
| | 0.5% | P18 | |
| | q.s. | Preservative | |

(78)

| | | | |
|---|---|---|---|
| A | 4.50 | Uvinul MC 80 | Ethylhexyl methoxycinnamate |
| | 3.00 | Uvinul N 539 T | Octocrylene |
| | 1.00 | Uvinul T 150 | Ethylhexyltriazone |
| | 2.50 | Cosmacol EMI | Di-$C_{12-13}$-alkyl malate |
| B | 0.50 | Vitamin E acetate | Tocopheryl acetate |
| | 4.00 | Tego Care 450 | Polyglyceryl-3 methylglucose distearate |
| C | 3.50 | Cetiol SN | Cetearyl isononanoate |
| | 1.00 | Ganex V-220 | VP/eicosene copolymer |
| | 5.00 | Isohexadecane | Isohexadecane |
| | 2.50 | Cosmacol EMI | Di-$C_{12-13}$-alkyl malate |
| | 5.00 | Z-COTE MAX | Zinc oxide (and) diphenylcaprylmethicone |
| D | 44.00 | Water dem. | Aqua dem. |
| | 5.00 | Glycerol 87% | Glycerol |
| | 1.00 | Lanette E | Sodium cetearyl sulfate |
| | 15.00 | Luviquat Care | Polyquaternium-44 |
| | 1.0% | P18 | |
| | 0.50 | Keltrol | Xanthan gum |
| E | 1.00 | Phenonip | |

(79)

| | | | |
|---|---|---|---|
| A | 4.50 | Uvinul MC 80 | Ethylhexyl methoxycinnamate |
| | 3.00 | Uvinul N 539 T | Octocrylene |
| | 1.00 | Tinosorb S | Bisethoxyhexyloxyphenol methoxyphenyltriazine |
| | 2.50 | Cosmacol EMI | Di-$C_{12-13}$-alkyl malate |
| B | 0.50 | Vitamin E acetate | Tocopheryl acetate |
| | 4.00 | Tego Care 450 | Polyglyceryl-3 methylglucose distearate |
| C | 3.50 | Cetiol SN | Cetearyl isononanoate |
| | 1.00 | Ganex V-220 | VP/eicosene copolymer |
| | 5.00 | Isohexadecane | Isohexadecane |
| | 2.50 | Cosmacol EMI | Di-$C_{12-13}$-alkyl malate |
| | 5.00 | Z-COTE MAX | Zinc oxide (and) diphenylcaprylmethicone |
| D | 44.90 | Water dem. | Aqua dem. |
| | 5.00 | Glycerol 87% | Glycerol |
| | 1.00 | Lanette E | Sodium cetearyl sulfate |
| | 15.00 | Luviquat Care | Polyquaternium-44 |
| | 0.1% | P18 | |
| | 0.50 | Keltrol | Xanthan gum |
| E | 1.00 | Phenonip | |

(80)

| | | | |
|---|---|---|---|
| A | 1.50 | Mexoryl XL | Drometrizole trisiloxane |
| | 5.00 | Uvinul N 539 T | Octocrylene |
| | 1.00 | Tinosorb S | Bisethylhexyloxyphenol methoxyphenyltriazine |
| | 2.50 | Cosmacol EMI | Di-$C_{12-13}$-alkyl malate |
| B | 0.50 | Vitamin E acetate | Tocopheryl acetate |
| | 4.00 | Tego Care 450 | Polyglyceryl-3 methylglucose distearate |
| C | 3.50 | Cetiol SN | Cetearyl isononanoate |
| | 1.00 | Ganex V-220 | VP/eicosene copolymer |
| | 5.00 | Isohexadecane | Isohexadecane |
| | 2.50 | Cosmacol EMI | Di-$C_{12-13}$-alkyl malate |
| | 5.00 | Z-COTE MAX | Zinc oxide (and) diphenylcaprylmethicone |
| D | 44.50 | Water dem. | Aqua dem. |
| | 5.00 | Glycerol 87% | Glycerol |
| | 1.00 | Lanette E | Sodium cetearyl sulfate |
| | 15.00 | Luviquat Care | Polyquaternium-44 |
| | 1.5% | P18 | |
| | 0.50 | Keltrol | Xanthan gum |
| E | 1.00 | Phenonip | |

(81)

| | | | |
|---|---|---|---|
| A | 1.50 | Mexoryl XL | Drometrizole trisiloxane |
| | 5.00 | Uvinul N 539 T | Octocrylene |
| | 1.00 | Tinosorb S | Bisethylhexyloxyphenol methoxyphenyltriazine |

(continued)

| | | | |
|---|---|---|---|
| | 2.50 | Cosmacol EMI | Di-C$_{12-13}$-alkyl malate |
| B | 0.50 | Vitamin E acetate | Tocopheryl acetate |
| | 4.00 | Tego Care 450 | Polyglyceryl-3 methylglucose distearate |
| C | 3.50 | Cetiol SN | Cetearyl isononanoate |
| | 1.00 | Ganex V-220 | VP/eicosene copolymer |
| | 5.00 | Isohexadecane | Isohexadecane |
| | 2.50 | Cosmacol EMI | Di-C$_{12-13}$-alkyl malate |
| | 5.00 | T-Lite SF | Titanium dioxide, aluminum hydrate, dimethicone/methicone copolymer |
| D | 45.00 | Water dem. | Aqua dem. |
| | 5.00 | Glycerol 87% | Glycerol |
| | 1.00 | Lanette E | Sodium cetearyl sulfate |
| | 15.00 | Luviquat Care | Polyquaternium-44 |
| | 1.0% | P18 | |
| | 0.50 | Keltrol | Xanthan gum |
| E | 1.00 | Phenonip | |

(82)

| | | | |
|---|---|---|---|
| A | 1.00 | Abil Care 85 | Bis-PEG-/PPG-16-/16-PEG-/PPG-16-/16-dimethicone, caprylic/capric triglyceride |
| | 3.00 | Cremophor CO 40 | PEG-40-hydrogenated castor oil |
| | 0.30 | Cremophor WO 7 | PEG-7-hydrogenated castor oil |
| | 5.00 | Uvinul MC 80 | Ethylhexyl methoxycinnamate |
| | 10.00 | Witconol APM | PPG-3 myristyl ether |
| | 2.00 | Uvinul T 150 | Ethylhexyltriazone |
| | 1.00 | Dow Corning 345 Fluid | Cyclopentasiloxane, cyclohexasiloxane |
| | 5.00 | Uvinul N 539 T | Octocrylene |
| B | 5.00 | Z-COTE MAX | Zinc oxide (and) diphenylcaprylmethicone |
| C | 5.00 | 1,2-Propylene glycol | Propylene glycol |
| | 0.20 | Keltrol | Xanthan gum |
| | 0.10 | Edeta BD | Disodium EDTA |
| | 2.0% | P18 | |
| | 1.50 | Simulgel 600 | Acrylamide/sodium acryloyldimethyltaurate copolymer, isohexadecane, polysorbate 80 |
| | 58.40 | Water dem. | Aqua dem. |
| D | q.s. | Perfume oil | |
| | 0.50 | Glydant | DMDM hydantoin |

(83)

| | | | |
|---|---|---|---|
| A | 2.00 | Abil Care 85 | Bis-PEG-/PPG-16-/16-PEG-/PPG-16-/16-dimethicone, caprylic/capric triglyceride |
| | 4.00 | Finsolv TN | C$_{12-15}$-Alkyl benzoate |
| | 1.50 | Miglyol 812 | Caprylic/capric triglyceride |
| | 0.50 | Vitamin E acetate | Tocopheryl acetate |
| | 7.50 | Uvinul MC 80 | Ethylhexyl methoxycinnamate |
| | 4.00 | Cetiol B | Dibutyl adipate |
| | 3.00 | Luvitol EHO | Cetearyl ethylhexanoate |
| | 1.00 | Cremophor CO 40 | PEG-40-hydrogenated castor oil |
| | 1.00 | Paraffin oil, thin-liquid | Mineral oil |
| | 3.00 | Plantacare 2000 | Decyl glucoside |
| | 0.50 | Phenonip | |
| | q.s. | Perfume oil | |
| B | 4.00 | Z-COTE MAX | Zinc oxide (and) diphenylcaprylmethicone |
| C | 2.00 | Simulgel NS | Hydroxyethyl acrylate/sodium acryloyldimethyltaurate copolymer, squalane, polysorbate 60 |
| | 0.20 | Keltrol | Xanthan gum |
| | 0.10 | Edeta BD | Disodium EDTA |
| | 1.0% | P18 | |
| | 64.20 | Water dem. | Aqua dem |

(84)

| | | | |
|---|---|---|---|
| A | 6.00 | Gilugel SIL 5 | Cyclomethicone (and) aluminum-/magnesium hydroxide stearate |
| | 5.00 | Uvinul MC 80 | Ethylhexyl methoxycinnamate |
| | 2.00 | Uvinul A Plus | Diethylaminohydroxybenzoylhexyl benzoate |
| | 1.00 | Uvinul T 150 | Ethylhexyltriazone |
| | 7.00 | Finsolv TN | C$_{12-15}$-Alkyl benzoate |
| | 4.00 | Abil WE 09 | Polyglyceryl-4 isostearate, cetyl-PEG-/PPG-10-/1-dimethicone, hexyl laurate |
| | 2.00 | Cosmacol EMI | Di-C$_{12-13}$-alkyl malate |
| | 3.00 | Isopropyl palmitate | Isopropyl palmitate |
| | 5.00 | Abil B 8839 | Cyclopentasiloxane, cyclohexasiloxane |
| | 0.50 | Abil 350 | Dimethicone |
| B | 0.50 | Sodium chloride | Sodium chloride |
| | 0.20 | Edeta BD | Disodium EDTA |
| | 0.2% | P18 | |
| | 62.10 | Water dem. | Aqua dem. |
| C | 1.00 | Vitamin E acetate | Tocopheryl acetate |
| | 0.50 | Phenonip | |

(85)

| | | | |
|---|---|---|---|
| A | 4.50 | Uvinul MC 80 | Ethylhexyl methoxycinnamate |
| | 2.00 | Tinosorb S | Bisethylhexyloxyphenol methoxyphenyltriazine |
| | 3.00 | Uvinul N 539 T | Octocrylene |
| | 2.50 | Cosmacol EMI | Di-C$_{12-13}$-alkyl malate |
| | 0.50 | Vitamin E acetate | Tocopheryl acetate |
| | 4.00 | Tego Care 450 | Polyglyceryl-3 methylglucose distearate |
| B | 3.50 | Cetiol SN | Cetearyl isononanoate |
| | 1.00 | Ganex V-220 | VP/eicosene copolymer |
| | 5.00 | Isohexadecane | Isohexadecane |
| | 2.50 | Cosmacol EMI | Di-C$_{12-13}$-alkyl malate |
| | 3.00 | T-Lite SF | Titanium dioxide, aluminum hydrate, dimethicone/methicone copolymer |
| C | 5.00 | Glycerol 87% | Glycerol |
| | 1.00 | Lanette E | Sodium cetearyl sulfate |
| | 0.50 | Keltrol | Xanthan gum |
| | 1.0% | P18 | |
| | 59.70 | Water dem. | Aqua dem. |
| D | 1.00 | Phenonip | |
| | 0.30 | Bisabolol rac. | Bisabolol |

(86)

| | | | |
|---|---|---|---|
| A | 2.00 | Abil Care 85 | Bis-PEG-/PPG-16-/16-PEG-/PPG-16-/16-dimethicone, caprylic/capric triglyceride |
| | 4.00 | Finsolv TN | C$_{12-15}$-Alkyl benzoate |
| | 1.50 | Miglyol 812 | Caprylic/capric triglyceride |
| | 0.50 | Vitamin E acetate | Tocopheryl acetate |
| | 7.50 | Uvinul MC 80 | Ethylhexyl methoxycinnamate |
| | 4.00 | Cetiol B | Dibutyl adipate |
| | 1.00 | Luvitol EHO | Cetearyl ethylhexanoate |
| | 1.00 | Cremophor CO 40 | PEG-40 hydrogenated castor oil |
| | 1.00 | Paraffin oil, thin-liquid | Mineral oil |
| | 3.00 | Plantacare 2000 | Decyl glucoside |
| | 1.00 | Uvinul A Plus | Diethylaminohydroxybenzoylhexyl benzoate |
| | 0.50 | Phenonip | |
| | 2.50 | Uvinul T 150 | Ethylhexyltriazone |
| | q.s. | Perfume oil | |
| B | 4.00 | Z-COTE MAX | Zinc oxide (and) diphenylcapryl-methicone |
| C | 2.00 | Simulgel NS | Hydroxyethyl acrylate/sodium acryloyldimethyltaurate copolymer, squalane, polysorbate 60 |

(87)

| | | | |
|---|---|---|---|
| A | 4.00 | Eumulgin VL 75 | Lauryl glucoside, polyglyceryl-2 dipolyhydroxystearate, glycerol |
| | 2.00 | Lanette O | Cetearyl alcohol |
| | 12.00 | Myritol 331 | Cocoglycerides |
| | 8.00 | Finsolv TN | $C_{12-15}$-Alkyl benzoate |
| | 8.00 | Cetiol B | Dibutyl adipate |
| B | 6.00 | T-Lite SF | Titanium dioxide, aluminum hydrate, dimethicone/methicone copolymer |
| | 5.00 | Z-COTE MAX | Zinc oxide (and) diphenylcapryl-methicone |
| C | 3.00 | Glycerol 87% | Glycerol |
| | 0.10 | Edeta BD | Disodium EDTA |
| | 1.50 | Veegum Ultra | Magnesium aluminum silicate |
| | 1.50 | Lanette E | Sodium cetearyl sulfate |
| | 2.0% | P18 | |
| | 0.30 | Keltrol | Xanthan gum |
| | 45.10 | Water dem. | Water |
| D | 1.00 | Phenonip | Phenoxyethanol, methyl paraben, ethyl paraben, butyl paraben, propyl paraben, isobutyl paraben |

(88)

| | | | |
|---|---|---|---|
| A | 4.00 | Eumulgin VL 75 | Lauryl glucoside, polyglyceryl-2 dipolyhydroxystearate, glycerol |
| | 2.00 | Lanette O | Cetearyl alcohol |
| | 12.00 | Myritol 331 | Cocoglycerides |
| | 8.00 | Finsolv TN | $C_{12-15}$-Alkyl benzoate |
| | 8.00 | Cetiol B | Dibutyl adipate |
| B | 6.00 | Uvinul N 539 T | Octocrylene |
| | 5.00 | Z-COTE MAX | Zinc oxide (and) diphenylcapryl-methicone |
| C | 3.00 | Glycerol 87% | Glycerol |
| | 0.10 | Edeta BD | Disodium EDTA |
| | 1.50 | Veegum Ultra | Magnesium aluminum silicate |
| | 1.50 | Lanette E | Sodium cetearyl sulfate |
| | 0.30 | Carbopol Ultrez 10 P | Carbomer |
| | 1.0% | P18 | |
| | 46.10 | Water dem. | Aqua dem. |
| D | 1.00 | Phenonip | Phenoxyethanol, methyl paraben, ethyl paraben, butyl paraben, propyl paraben, isobutyl paraben |

(89)

| | | | |
|---|---|---|---|
| A | 4.00 | Eumulgin VL 75 | Lauryl glucoside, polyglyceryl-2 dipolyhydroxystearate, glycerol |
| | 2.00 | Lanette O | Cetearyl alcohol |
| | 10.00 | Myritol 331 | Cocoglycerides |
| | 8.00 | Finsolv TN | $C_{12-15}$-Alkyl benzoate |
| | 8.00 | Cetiol B | Dibutyl adipate |
| B | 2.00 | Uvinul A Plus | Diethylaminohydroxybenzoylhexyl benzoate |
| | 5.00 | Z-COTE MAX | Zinc oxide (and) diphenylcapryl-methicone |
| C | 3.00 | Glycerol 87% | Glycerol |
| | 0.10 | Edeta BD | Disodium EDTA |
| | 1.50 | Veegum Ultra | Magnesium aluminum silicate |
| | 1.50 | Lanette E | Sodium cetearyl sulfate |
| | 5.0% | P18 | |
| | 0.30 | Carbopol Ultrez 10 P | Carbomer |
| | ad | Water dem. | Water |
| D | 1.00 | Phenonip | Phenoxyethanol, methyl paraben, ethyl paraben, butyl paraben, propyl paraben, isobutyl paraben |

(90)

| | | | |
|---|---|---|---|
| A | 3.50 | Cremophor A 6 | Ceteareth-6, stearyl alcohol |
| | 1.50 | Cremophor A 25 | Ceteareth-25 |
| | 7.50 | Uvinul MC 80 | Ethylhexyl methoxycinnamate |
| | 2.00 | Uvinul A Plus | Diethylaminohydroxybenzoylhexyl benzoate |
| | 2.00 | Dow Corning 345 | Cyclopentasiloxane, cyclohexasiloxane fluid |
| | 0.50 | Beeswax 3044 PH | Beeswax |
| | 3.00 | Lanette O | Cetearyl alcohol |
| | 10.00 | Miglyol 812 | Caprylic/capric triglyceride |
| B | 5.00 | T-Lite SF-S | Titanium dioxide, silicon hydrate, aluminum hydrate, methicone/dimethicone copolymer |
| C | 3.00 | Glycerol 87% | Glycerol |
| | 0.20 | Edeta BD | Disodium EDTA |
| | 0.30 | Keltrol T | Xanthan gum |
| | 1.00 | Plantacare 2000 | Decyl glucoside |
| | 2.0% | P18 | |
| | 57.30 | Water dem. | Aqua dem. |
| D | 1.00 | Vitamin E acetate | Tocopheryl acetate |
| | 0.20 | Bisabolol rac. | Bisabolol |

(91)

| | | | |
|---|---|---|---|
| A | 10.00 | Uvinul A Plus B | Ethylhexyl methoxycinnamate, diethylaminohydroxybenzoylhexyl benzoate |
| | 10.00 | Uvinul N 539 T | Octocrylene |
| | 4.00 | Eumulgin VL 75 | Lauryl glucoside, polyglyceryl-2 dipolyhydroxystearate, glycerol |
| | 8.00 | Cetiol B | Dibutyl adipate |
| | 8.00 | Finsolv TN | $C_{12-15}$-Alkyl benzoate |
| | 12.00 | Myritol 331 | Cocoglycerides |
| | 1.00 | Lanette E | Sodium cetearyl sulfate |
| | 2.00 | Lanette O | Cetearyl alcohol |
| B | 3.00 | Z-COTE MAX | Zinc oxide (and) diphenylcapryl-methicone |
| C | 35.08 | Water dem. | Aqua dem. |
| | 0.38 | Citric acid | Citric acid |
| | 2.9 | Glycerol 87% | Glycerol |
| | 0.05 | Edeta BD | Disodium EDTA |
| | 0.20 | Allantoin | Allantoin |
| | 0.30 | Keltrol | Xanthan gum |
| | 0.1% | P18 | |
| | 1.50 | Veegum Ultra | Magnesium aluminum silicate |
| D | 0.50 | Phenonip | |
| | 1.00 | Vitamin E acetate | Tocopheryl acetate |

(92)

| | | | |
|---|---|---|---|
| A | 0.70 | Cremophor A 25 | Ceteareth-25 |
| | 1.70 | Cremophor A 6 | Ceteareth-6, stearyl alcohol |
| | 2.00 | Uvinul A Plus | Diethylaminohydroxybenzoylhexyl benzoate |
| | 3.00 | Uvinul N 539 T | Octocrylene |
| | 3.00 | Z-COTE MAX | Zinc oxide (and) diphenylcapryl-methicone |
| | 2.00 | Abil B 8843 | PEG-14 dimethicone |
| | 3.60 | Lanette O | Cetearyl alcohol |
| | 4.00 | Uvinul MC 80 | Ethylhexyl methoxycinnamate |
| | 2.00 | Cetiol B | Dibutyl adipate |
| B | 4.00 | Glycerol 87% | Glycerol |
| | 0.20 | Edeta BD | Disodium EDTA |
| | 71.00 | Water dem. | Panthenol |
| C | 4.00 | Luvigel EM | Caprylic/capric triglyceride, sodium acrylate copolymer |
| D | 1.00 | Vitamin E acetate | Tocopheryl acetate |
| | 1.0% | P18 | |
| | 0.20 | Bisabolol rac. | Bisabolol |
| | q.s. | Preservative | |

(93)

| | | | |
|---|---|---|---|
| A | 7.50 | Uvinul MC 80 | Ethylhexyl methoxycinnamate |
| | 5.00 | Uvinul N 539 T | Octocrylene |
| | 3.00 | Emulgade PL 68/50 | Cetearyl glucoside, cetearyl alcohol |
| | 2.00 | Dracorin 100 SE | Glyceryl stearate, PEG-100 stearates |
| | 1.00 | Fitoderm | Squalane |
| | 0.50 | Cremophor WO 7 | PEG-7 hydrogenated castor oil |
| | 0.50 | Cremophor PS 20 | Polysorbate 20 |
| | 2.00 | Dry Flo Pure | Aluminum starch octenyl succinate |
| B | 5.00 | Z-COTE MAX | Zinc oxide (and) diphenylcapryl-methicone |
| | 0.03 | Sicomet Blue P 77 007 | C.I. 77 007, Ultramarine |
| C | 4.00 | 1,2-Propylene glycol Care | Propylene glycol |
| | 2.00 | D-Panthenol 50 P | Panthenol, propylene glycol |
| | 0.20 | Keltrol | Xanthan gum |
| | 0.50 | Simulgel 600 | Acrylamide/sodium acryloyl-dimethyltaurate copolymer, isohexadecane, polysorbate 80 |
| | 0.5% | P18 | |
| | 65.27 | Water dem. | Aqua dem. |
| | q.s. | Preservative | |
| | 0.50 | Vitamin E acetate | Tocopheryl acetate |

(94)

| | | | |
|---|---|---|---|
| A | 6.00 | Gilugel SIL 5 | Cyclomethicone (and) aluminum/magnesium hydroxide stearate |
| | 5.00 | Uvinul N 539 T | Octocrylene |
| | 2.00 | Mexoryl XL | Drometrizole trisiloxane |
| | 1.00 | Uvinul T 150 | Ethylhexyltriazone |
| | 3.00 | T-Lite SF-S | Titanium dioxide, silicon hydrate, aluminum hydrate, methicone/dimethicone copolymer |
| | 5.00 | Finsolv TN | $C_{12-15}$-Alkyl benzoate |
| | 4.00 | Abil WE 09 | Polyglyceryl-4 isostearate, cetyl-PEG-/PPG-10-/1-dimethicone, hexyl laurate |
| | 2.00 | Cosmacol EMI | Di-$C_{12-13}$-alkyl malate |
| | 3.00 | Isopropyl palmitate | Isopropyl palmitate |
| | 5.00 | Abil B 8839 | Cyclopentasiloxane, cyclohexasiloxane |
| | 0.50 | Abil 350 | Dimethicone |
| B | 0.50 | Sodium chloride | Sodium chloride |
| | 0.20 | Edeta BD | Disodium EDTA |
| | 1.0% | P18 | |
| | 61.30 | Water dem. | Aqua dem. |
| C | 1.00 | Vitamin E acetate | Tocopheryl acetate |
| | 0.50 | Phenonip | |

(95)

| | | | |
|---|---|---|---|
| A | 1.00 | Abil Care 85 | Bis-PEG-/PPG-16-/16-PEG-/PPG-16-/16-dimethicone, caprylic/capric triglyceride |
| | 3.00 | Cremophor CO 40 | PEG-40 hydrogenated castor oil |
| | 0.30 | Cremophor WO 7 | PEG-7 hydrogenated castor oil |
| | 5.00 | Uvinul N 539 T | Octocrylene |
| | 10.00 | Witconol APM | PPG-3 myristyl ether |
| | 2.00 | Uvinul T 150 | Ethylhexyltriazone |
| | 1.00 | Dow Corning 345 Fluid | Cyclopentasiloxane, cyclohexasiloxane |
| | 2.00 | Uvinul A Plus | Diethylaminohydroxybenzoylhexyl benzoate |
| B | 5.00 | Z-COTE MAX | Zinc oxide (and) diphenylcaprylsilane |
| C | 5.00 | 1,2-Propylene glycol | Propylene glycol |
| | 0.20 | Keltrol | Xanthan gum |
| | 0.10 | Edeta BD | Disodium EDTA |
| | 1.0% | P18 | |
| | 1.50 | Simulgel 600 | Acrylamide/sodium acryloyldimethyl-taurate copolymer, isohexadecane, polysorbate 80 |
| | 59.40 | Water dem. | Aqua dem. |
| D | q.s. | Perfume oil | |
| | 0.50 | Glydant | DMDM hydantoin |

(96)

| | | | |
|---|---|---|---|
| A | 7.00 | Uvinul A Plus B | Ethylhexyl methoxycinnamate, diethylaminohydroxybenzoylhexyl benzoate |
| | 1.00 | Tinosorb S | Bisethylhexyloxyphenol methoxyphenyltriazine |
| | 1.00 | Uvinul T 150 | Ethylhexyltriazone |
| | 7.00 | Uvinul N 539 T | Octocrylene |
| | 4.00 | Eumulgin VL 75 | Lauryl glucoside, polyglyceryl-2 dipolyhydroxystearate, glycerol |
| | 8.00 | Cetiol B | Dibutyl adipate |
| | 8.00 | Finsolv TN | $C_{12-15}$-Alkyl benzoate |
| | 12.00 | Myritol 331 | Cocoglycerides |
| | 1.00 | Lanette E | Sodium cetearyl sulfate |
| | 2.00 | Lanette O | Cetearyl alcohol |
| B | 5.00 | Z-COTE MAX | Zinc oxide (and) diphenylcapryl-methicone |
| C | 35.35 | Water dem. | Aqua dem. |
| | 3.00 | Glycerol 87% | Glycerol |
| | 0.05 | Edeta BD | Disodium EDTA |
| | 0.20 | Allantoin | Allantoin |
| | 0.30 | Keltrol | Xanthan gum |
| | 0.1% | P18 | |
| | 1.50 | Veegum Ultra | Magnesium aluminum silicate |
| D | 0.50 | Phenonip | |
| | 1.00 | Vitamin E acetate | Tocopheryl acetate |

(97)

| | | | |
|---|---|---|---|
| A | 7.00 | Uvinul A Plus B | Ethylhexyl methoxycinnamate, diethylaminohydroxybenzoylhexyl benzoate |
| | 1.00 | Tinosorb S | Bisethylhexyloxyphenol methoxyphenyltriazine |
| | 1.00 | Uvinul T 150 | Ethylhexyltriazone |
| | 7.00 | Uvinul N 539 T | Octocrylene |
| | 4.00 | Eumulgin VL 75 | Lauryl glucoside, polyglyceryl-2 dipolyhydroxystearate, glycerol |
| | 8.00 | Cetiol B | Dibutyl adipate |
| | 8.00 | Finsolv TN | $C_{12-15}$-Alkyl benzoate |
| | 12.00 | Myritol 331 | Cocoglycerides |
| | 1.00 | Lanette E | Sodium cetearyl sulfate |
| | 2.00 | Lanette O | Cetearyl alcohol |
| B | 5.00 | T-Lite SF | Titanium dioxide, aluminum hydrate, dimethicone/methicone copolymer |
| C | 30.45 | Water dem. | Aqua dem. |
| | 3.00 | Glycerol 87% | Glycerol |
| | 0.05 | Edeta BD | Disodium EDTA |
| | 0.20 | Allantoin | Allantoin |
| | 0.30 | Keltrol | Xanthan gum |
| | 5.0% | P18 | |
| | 1.50 | Veegum Ultra | Magnesium aluminum silicate |
| D | 0.50 | Phenonip | |
| | 1.00 | Vitamin E acetate | Tocopheryl acetate |

(98)

| | | |
|---|---|---|
| 5.00 | Z-COTE MAX | Zinc oxide (and) diphenylcapryl-methicone |
| 2.00 | Uvinul A Plus | Diethylaminohydroxybenzoylhexyl benzoate |
| 2.00 | Mexoryl XL | Drometrizole trisiloxane |
| 3.00 | Uvinul MC 80 | Ethylhexyl methoxycinnamate |
| 0.50 | Abil 350 | Dimethicone |
| 2.75 | Carnico wax LT 20 | Carnauba (*Copernica cerifera*) wax, paraffin |
| 3.70 | Candelilla wax LT 281 LJ | Candelilla (*Euphorbia cerifera*) wax |

-continued

| | | | |
|---|---|---|---|
| | 1.80 | Beeswax 3050 PH | Beeswax |
| | 3.20 | TeCero-wax 30445 | Microcrystalline wax |
| | 3.20 | TeCero-wax 1030 K | Microcrystalline wax |
| | 1.34 | Cutina CP | Cetyl palmitate |
| | 6.40 | Vaseline | Petrolatum |
| | 7.30 | Softisan 100 | Hydrogenated cocoglycerides |
| | 10.00 | Luvitol EHO | Cetearyl ethylhexanoate |
| | 0.17 | Bisabolol nat. | Bisabolol |
| | 1.84 | Vitamin E acetate | Tocopheryl acetate |
| | 1.0% | P18 | |
| | 0.42 | D,L-Alpha-tocopherol | Tocopherol |
| | 40.38 | Castor oil | Castor (*Ricinus communis*) oil |

(99)

| | | | |
|---|---|---|---|
| A | 1.00 | Abil Care 85 | Bis-PEG-/PPG-16-/16-PEG-/PPG-16-/16-dimethicone, caprylic/capric triglyceride |
| | 3.00 | Cremophor CO 40 | PEG-40 hydrogenated castor oil |
| | 0.30 | Cremophor WO 7 | PEG-7 hydrogenated castor oil |
| | 2.00 | Mexoryl XL | Drometrizole trisiloxane |
| | 10.00 | Witconol APM | PPG-3 myristyl ether |
| | 1.00 | Uvinul T 150 | Ethylhexyltriazone |
| | 1.00 | Dow Corning 345 Fluid | Cyclopentasiloxane, cyclohexasiloxane |
| | 5.00 | Uvinul N 539 T | Octocrylene |
| B | 3.00 | T-Lite SF-S | Titanium dioxide, silicon hydrate, aluminum hydrate, methicone/dimethicone copolymer |
| C | 5.00 | 1,2-Propylene glycol | Propylene glycol |
| | 1.00 | Mexoryl SX | Terephthalidenedicamphorsulfonic acid |
| | 0.20 | Keltrol | Xanthan gum |
| | 0.10 | Edeta BD | Disodium EDTA |
| | 1.0% | P18 | |
| | 1.50 | Simulgel 600 | Acrylamide/sodium acryloyldimethyltaurate copolymer, isohexadecane, polysorbate 80 |
| | 69.50 | Water dem. | Aqua dem. |
| D | q.s. | Perfume oil | |
| | 0.50 | Glydant | DMDM hydantoin |

(100)

| | | | |
|---|---|---|---|
| A | 1.00 | Abil Care 85 | Bis-PEG-/PPG-16-/16-PEG-/PPG-16-/16-dimethicone, caprylic/capric triglyceride |
| | 3.00 | Cremophor CO 40 | PEG-40 hydrogenated castor oil |
| | 0.30 | Cremophor WO 7 | PEG-7 hydrogenated castor oil |
| | 2.00 | Parsol 1789 | Butylmethoxydibenzoylmethane |
| | 2.00 | Mexoryl XL | Drometrizole trisiloxane |
| | 10.00 | Witconol APM | PPG-3 myristyl ether |
| | 1.00 | Uvinul T 150 | Ethylhexyltriazone |
| | 1.00 | Dow Corning 345 Fluid | Cyclopentasiloxane, cyclohexasiloxane |
| | 5.00 | Uvinul N 539 T | Octocrylene |
| B | 3.00 | T-Lite SF-S | Titanium dioxide, silicon hydrate, aluminum hydrate, methicone/dimethicone copolymer |
| C | 5.00 | 1,2-Propylene glycol | Propylene glycol |
| | 1.00 | Mexoryl SX | Terephthalidenedicamphorsulfonic acid |
| | 0.20 | Keltrol | Xanthan gum |
| | 0.10 | Edeta BD | Disodium EDTA |
| | 0.2% | P18 | |
| | 1.50 | Simulgel 600 | Acrylamide/sodium acryloyldimethyltaurate copolymer, isohexadecane, polysorbate 80 |
| | 68.30 | Water dem. | Aqua dem. |
| D | q.s. | Perfume oil | |
| | 0.50 | Glydant | DMDM hydantoin |

(101)

| | | | |
|---|---|---|---|
| A | 0.70 | Cremophor A 25 | Ceteareth-25 |
| | 1.70 | Cremophor A 6 | Ceteareth-6, stearyl alcohol |
| | 2.00 | Parsol 1789 | Butylmethoxydibenzoylmethane |
| | 5.00 | Uvinul N 539 T | Octocrylene |
| | 4.00 | Z-COTE MAX | Zinc oxide (and) diphenylcaprylmethicone |
| | 2.00 | Abil B 8843 | PEG-14 dimethicone |
| | 3.60 | Lanette O | Cetearyl alcohol |
| | 1.00 | Uvinul T150 | Ethylhexyltriazone |
| | 2.00 | Cetiol B | Dibutyl adipate |
| B | 4.00 | Glycerol 87% | Glycerol |
| | 0.20 | Edeta BD | Disodium EDTA |
| | 71.00 | Water dem. | Panthenol |
| C | 4.00 | Luvigel EM | Caprylic/capric triglyceride, sodium acrylate copolymer |
| | 1.0% | P18 | |
| D | 1.00 | Vitamin E acetate | Tocopheryl acetate |
| | 0.20 | Bisabolol rac. | Bisabolol |
| | q.s. | Preservative | |

Example 39

Use of P18 in a Hair Tonic

AI 5%:

| | % | Ingredient (INCI) |
|---|---|---|
| A | q.s. | Perfume oil |
| | 1.00 | PEG-40 Hydrogenated Castor Oil |
| B | 65.0 | Alcohol |
| | 1.0 | Panthenol |
| | 0.5 | Polyquarternium-16 |
| | 0.1 | Menthol |
| | 27.4 | Aqua dem. |
| | 5.00 | Aqueous solution with about 7% P18 |

Preparation: Mix phase A. Add phase B and stir until everything has dissolved. Adjust pH to pH 7.0.

Example 40

Use of P18 in a Hair Gel

AI 5%:

| | % | Ingredient (INCI) |
|---|---|---|
| A | 45.00 | Carbopol 940 1% in water |
| | 0.70 | Aminomethyl Propanol |
| B | 7.50 | VP/Methacrylamide/Vinyl Imidazole Copolymer |
| | 0.10 | Perfume oil |
| | 0.30 | PEG-40 Hydrogenated Castor Oil |
| | 0.30 | Preservative |
| | 0.05 | Disodium EDTA |
| | 0.30 | Panthenol |
| | 8.00 | Alcohol |
| | 5.00 | Aqueous solution with about 7% P18 |
| | 32.75 | Aqua dem. |

Preparation: Weigh in the components of phase A and homogenize. Dissolve phase B and stir into phase A. Adjust pH to pH 6.9.

3. Test Examples B

Example 41

Long-Term Stability of P18 Tested on *Malassezia furfur*

Since storage over longer time periods may be necessary, in the following a 1 mM P18 peptide solution (P18 sequence H-KWKLFKKIPKFLHLAKKF-NH$_2$; SEQ ID NO: 3) was stored for 12 weeks at 37° C. and the antifungal activity of the stored solution on *Malassezia furfur* was compared to the activity of a freshly prepared 1 mM P18 peptide solution. This was done through a growth test, which was carried out as follows:

Growth medium: M472-Pityrosporum medium according to DSMZ 40 g/L malt extract 20 g/L ox bile 10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 100 μl of M472-Pityrosporum medium and inoculated with *M. furfur* suspension of the overnight culture. The *M. furfur* suspension was adjusted at the start of the experiment to an optical density, measured at 600 nm, of 0.02. The concentrates of the inhibitor solutions were 1 mM in water.

The growth of the following batches was compared:

*M. furfur* suspension without the addition of an inhibitor.

*M. furfur* suspension and addition of a fresh aqueous P18 solution with a final concentration of 50 μM.

*M. furfur* suspension and addition of a fresh aqueous P18 solution with a final concentration of 25 μM.

*M. furfur* suspension and addition of a P18 solution that had been stored at 37° C. for 12 weeks, with a final concentration of 50 μM.

*M. furfur* suspension and addition of a P18 solution that had been stored at 37° C. for 12 weeks, with a final concentration of 25 μM.

The microtiter plate was incubated with shaking at 30° C.

The growth was observed over 24 hours by measuring the optical density. The colony-forming units (CFU) were then determined by plating out 1 μl and 5 μl from each of the suspensions and, after incubation for 6 days, counting the colonies. The CFU was determined in order to exclude an influence of the two-phase medium and also the growth form of *M. furfur* on the optical density. The experiments were carried out at least in triple determinations.

TABLE 7

Counting the colony-forming units (the values given are mean values with standard deviation)

| Incubation time [h] | without inhib. | addition of aqueous P18 solution [50 μM final conc.] | addition of stored aqueous P18 solution [50 μM final conc.] | addition of aqueous P18 solution [25 μM final conc.] | addition of stored aqueous P18 solution [25 μM final conc.] |
|---|---|---|---|---|---|
| 16-18 | >1000 | 0 ± 0 | 0 ± 0 | 5 ± 8 | 6 ± 7 |
| 24 | >1000 | 1 ± 1 | 1 ± 1 | 1 ± 2 | 5 ± 5 |

The results of the growth test show that the growth of *M. furfur*, measured as colony forming unit, was effectively inhibited by the P18 peptide solution that had been stored for 12 weeks as well as by the fresh P18 peptide solution. This means that the storage of the P18 peptide solution has not influenced the activity of the solution and, consequently, that the solution was storable over this time period.

Example 42

Formulability of P18

The formulability of the peptide P18 was tested in three shampoo basic formulations. For this, in a first step the formulations with the following compositions were prepared:

TABLE 8 composition of the basic formulations

| Trade name (INCI) | formulation 31-1 | formulation 31-2 | formulation 31-3 |
|---|---|---|---|
| Texapon NSO (Sodium Laureth Sulfate) | 40% | 30% | 20% |
| Tego Betain L7 (Cocamidopropyl Betaine) | 10% | 10% | 20% |

The components were mixed and dissolved. The pH was adjusted to pH 6-7 with NaOH. In the following, two 100 mM solutions of the peptide P18 (P18 sequence H-KWKLFK-KIPKFLHLAKKF-NH$_2$; SEQ ID NO: 3) were prepared. One solution was prepared using DMSO as solvent, the other solution was prepared using water. A corresponding volume of 100 mM peptide solution was added to each of the formulations, so that the final concentration in formulations 31-1 and 31-2 was 10 mM, the final concentration of the peptide P18 in formulation 31-3 was 5 mM. The formulations thus obtained were clear and homogenic.

Example 43

Effect of Shampoo Basic Formulations Containing P18 as Ingredient

The aim of the experiment was to analyze the effect of a shampoo basic formulation containing the peptide P18 as ingredient (P18 sequence H-KWKLFKKIPKFLHLAKKF-NH$_2$). For this, in this experiment the peptide P18 was directly added to the formulation. In a first step, formulations with the following compositions were prepared:

TABLE 9

Composition of the shampoo basic formulation and the shampoo basic formulation containing P18 as ingredient.

| Trade name (INCI) | shampoo basic formulation 31-3 | shampoo basic formulation 31-3 containing P18 as ingredient |
|---|---|---|
| Texapon NSO (Sodium Laureth Sulfate) | 20% | 20% |
| Tego Betain L7 (Cocamidopropyl Betaine) | 20% | 20% |
| peptide P18 (H-KWKLFKKIPKFLHLAKKF-NH$_2$) | — | 5 mM (~1%) |

The components Texapon NSO and Tego Betain L7 were mixed and dissolved. The pH was adjusted to pH 6-7 with NaOH. In the following, a 100 mM aqueous solution of the peptide P18 (P18 sequence H-KWKLFKKIPKFLHLAKKF-NH$_2$; SEQ ID NO: 3) was prepared. A corresponding volume of the 100 mM P18 peptide solution was added to the formulation, so that the final concentration of the peptide P18 in formulation 31-3 was 5 mM. As described above, the formulation thus obtained was clear and homogenic. The effectiveness of the formulations against the fungus *Malassezia furfur* was then compared to the shampoo basic formulation containing no peptide P18.

In summary, the test was carried out as follows:
Growth medium: M472-Pityrosporum medium according to DSMZ
40 g/L malt extract
20 g/L ox bile
10 g/L Tween 40
The components were sterilized at 121° C., 1 bar superatmospheric pressure for 20 minutes.
2 g/L of olive oil (sterilized by filtration and, after autoclaving, added to the other components)
Since it was a two-phase medium, the complete medium was treated with sonication in order to enlarge the phase boundary.
For agar plates, if appropriate, 150 g/L of agar agar were added to the medium.
The growth test was carried out as follows: A shake flask with M472-Pityrosporum medium was inoculated with *M. furfur* and incubated with shaking overnight at 30° C. and 200 rpm.
A 96-well microtiter plate was filled with in each case 170 μl of M472-Pityrosporum medium and inoculated with 10 μl of *M. furfur* suspension of the overnight culture. This corresponded to an optical density, measured at 620 nm, of 0.02-0.1. 20 μl of shampoo basic formulation and 20 μl of shampoo basic formulation 31-3 containing P18 as ingredient, respectively, were added to this mixture.
Thus, in summary, the following mixtures were compared in this experiment:
*M. furfur* suspension
*M. furfur* suspension and addition of 20 μl of shampoo basic formulation 31-3
*M. furfur* suspension and addition of 20 μl of shampoo basic formulation 31-3 containing P18 as ingredient.
The microtiter plate was incubated with shaking at 30° C. After 24 hours of incubation, the colony-forming units (CFU) were determined by resuspending 1 μl of each suspension in 10 μl of medium and then plating out the obtained suspension. After incubation for 6 days, the colonies on the plate were counted. The CFU was determined in order to exclude an influence of the two-phase medium and also the growth form of *M. furfur* on the optical density. The experiments were carried out in at least two independent experiments, each with double determination.

TABLE 10

Counting the colony-forming units after incubation for 24 hours

| | *M. furfur* suspension | *M. furfur* suspension and addition of shampoo basic formulation 31-3 | *M. furfur* suspension and addition of shampoo basic formulation 31-3 containing P18 as ingredient |
|---|---|---|---|
| 24 h | >2000 | 300 ± 199 | 0 ± 0 |

The results show that shampoo basic formulation 31-3 per se already has a measurable growth inhibiting effect against *Malassezia furfur*. However, with shampoo basic formulation 31-3 containing P18 as ingredient there is no measurable growth at all. This shows that the antifungal effect of the peptide P18 is maintained in this formulation. Since no growth of *M. furfur* could be measured, it can actually be assumed that even lower concentrations of the ingredient P18 or comparable peptides or other comparable formulations can be used to inhibit the growth of *Malassezia furfur* and other *Malassezia* ssp.

Example 44

Growth Inhibition of *Malassezia furfur* with Equal Concentrations of the Peptide P18, Zincpyrithione, Climbazole and Ketoconazole, Based on % by Weight (%(Weight/Weight)

The molar masses of the peptide P18 (P18 peptide sequence H-KWKLFKKIPKFLHLAKKF-NH$_2$) and the current commercial ingredients of antidandruff shampoos inhibiting the growth of the fungus *Malassezia furfur* differ considerably. The peptide P18 has a molar mass of 2300 g/mol, Zincpyrithione has 317 g/mol, Ketokonazol has 531 g/mol and Climbazole has a molar mass of 292 g/mol. Since the experiments analyzing growth inhibition of *M. furfur* had been carried out with comparable molarities in the preceding examples, in this example growth inhibition of *Malassezia furfur* was analyzed using equal concentrations of the peptide P18, Zincpyrithione, Climbazole and Cetoconazol, based on % by weight (% (weigth/weight). For this, the procedure was as follows:
Growth medium: M472-Pityrosporum medium according to DSMZ
40 g/L malt extract
20 g/L ox bile
10 g/L Tween 40
The components were sterilized at 121° C., 1 bar superatmospheric pressure for 20 minutes.
2 g/L of olive oil (sterilized by filtration and, after autoclaving, added to the other components)
Since it was a two-phase medium, the complete medium was treated with sonication in order to enlarge the phase boundary.
For agar plates, if appropriate, 150 g/L of agar agar were added to the medium.
The growth test was carried out as follows: A shake flask with M472-Pityrosporum medium was inoculated with *M. furfur* and incubated with shaking overnight at 30° C. and 200 rpm.

A 96-well microtiter plate was filled with in each case 100 µl of M472-Pityrosporum medium and inoculated with *M. furfur* suspension of the overnight culture. The *M. furfur* suspension was adjusted at the start of the experiment to an optical density, measured at 600 nm, of 0.02. The concentrates of the inhibitor solutions were 1 mM in DMSO for the peptide P18 and 10 mM in DMSO for Zincpyrithione, Ketoconazole and Climbazole. The DMSO final concentrations were maintained the same in all experiments. This means that a corresponding volume of DMSO was added to the mixture in the case of a higher concentration of Zincpyrithione, Ketoconazole or Climbazole concentrate in order to ensure comparability to the mixtures containing P18.

The growth of the following batches was compared by measuring the optical density:

*M. furfur* suspension and addition of P18 solution with a final concentration of 50 µM (equal to 0.0115% (w/w))

*M furfur* suspension and addition of Zincpyrithione (ZPT) solution with a final concentration of 362 µM (comparison to the mixture containing 50 µM of the peptide P18)

*M furfur* suspension and addition of Ketoconazole solution with a final concentration of 216 µM (comparison to the mixture containing 50 µM of the peptide P18)

*M furfur* suspension and addition of Climbazole solution with a final concentration of 390 µM (comparison to the mixture containing 50 µM of the peptide P18)

The microtiter plate was incubated with shaking at 30° C.

After 24 hours of incubation, the colony-forming units (CFU) were determined by plating out 10 µl of medium from each of the suspensions on agar plates. After incubation for 6 days, the colonies on the plates were counted. The CFU was determined in order to exclude an influence of the two-phase medium and also the growth form of *M. furfur* on the optical density. The experiments were carried out in at least two independent experiments, each with double determination.

TABLE 11

Counting the colony-forming units (the values given are mean values from the experiments with standard deviation)

| Incubation time [h] | addition of P18 peptide solution [50 µM final conc.] | addition of Zincpyrithione solution [362 µM final conc.] | addition of Climbazole solution [390 µM final conc.] | addition of Ketoconazole solution [216 µM final conc.] |
|---|---|---|---|---|
| 24 | 1 ± 1 | 60 ± 40 | 137 ± 33 | 84 ± 76 |
| 40 | 0 ± 0 | 26 ± 7 | 35 ± 15 | 9 ± 5 |

It was observed that within the experimental period the addition of the peptide P18 reduced the CFU and, consequently, the growth of *Malassezia furfur* more effectively than the reference substances Zincpyrithione, Climbazole and Ketoconazole.

These results show effective, at least comparable growth inhibition of *Malassezia furfur* by the peptide P18 compared to Zincpyrithione, Climbazole and Ketoconazole with equal concentrations, based on % by weight (% (w/w)).

Example 45

Incubation Times with the Peptide P18 from 5 Minutes to 1 Hour

Since growth inhibition of *M. furfur* by the peptide P18 (P18 peptide sequence H-KWKLFKKIPKFLHLAKKF-NH$_2$; SEQ ID NO: 3) had so far only been analyzed over incubation times of more than one hour, now the effect of the peptide P18 within the first minutes of incubation (5 minutes, 10 minutes and 20 minutes) up to the first hour after adding to the *M. furfur* overnight culture was tested and compared to the reference substance Zincpyrithione (Sigma Aldrich). For this, the peptide P18 and the reference substance Zincpyrithione were used in concentrations of 100 µM, 200 µM and 500 µM. The experiments were carried out as follows:

Growth medium: M472-Pityrosporum medium according to DSMZ 40 g/L malt extract 20 g/L ox bile 10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 100 µl of M472-Pityrosporum medium and inoculated with *M. furfur* suspension of the overnight culture. The *M. furfur* suspension was adjusted at the start of the experiment to an optical density, measured at 600 nm, of 0.1.

The growth of the following batches was compared:

*M. furfur* suspension and addition of the peptide P18 with a final concentration of 100 µM, plating out after 5 minutes, 10 minutes, 20 minutes and 60 minutes

*M. furfur* suspension and addition of the peptide P18 with a final concentration of 200 µM plating out after 5 minutes, 10 minutes, 20 minutes and 60 minutes

*M. furfur* suspension and addition of the peptide P18 with a final concentration of 500 µM plating out after 5 minutes, 10 minutes, 20 minutes and 60 minutes

*M. furfur* suspension and addition of Zincpyrithione with a final concentration of 100 µM plating out after 5 minutes, 10 minutes, 20 minutes and 60 minutes

*M. furfur* suspension and addition of Zincpyrithione with a final concentration of 200 µM plating out after 5 minutes, 10 minutes, 20 minutes and 60 minutes

*M. furfur* suspension and addition of Zincpyrithione with a final concentration of 500 µM plating out after 5 minutes, 10 minutes, 20 minutes and 60 minutes The microtiter plate was incubated with shaking at 30° C.

After the incubation times indicated above, the colony-forming units (CFU) were determined by plating out 50 µl from each of the suspensions and, after incubation for 6 days, counting the colonies. The CFU was determined in order to exclude an influence of the two-phase medium and also the growth form of *M. furfur* on the optical density. The experiments were independently repeated. Below, those colony-forming units are indicated which showed less than 1000 colonies and thus a significant growth inhibition.

TABLE 12

Counting the colony-forming units after the indicated incubation time

| Substance | final concentration in the experiment [μM] | colony-forming units after the indicated incubation time | | | |
|---|---|---|---|---|---|
| | | 5 minutes | 10 minutes | 20 minutes | 60 minutes |
| P18 | 100 | >1000 | >1000 | 604 | 149 ± 60 |
| | 200 | >1000 | >1000 | >1000 | 52 ± 16 |
| | 500 | >1000 | 398 ± 290 | 26 ± 6 | 1 ± 1 |
| ZPT (Zincpyrithione) | 100 | >1000 | >1000 | >1000 | >1000 |
| | 200 | >1000 | >1000 | >1000 | >1000 |
| | 500 | >1000 | >1000 | >1000 | >1000 |

The results show that after the first 10 minutes of incubation with the peptide P18 the number of living *Malassezia furfur* cells was already considerably reduced as compared to incubation with Zincpyrithione. After 60 minutes of incubation with even lower peptide P18 concentrations the colony-forming units were considerably reduced as compared to shorter incubation times. This means that the mechanism of action of the peptide P18 clearly differs from the mechanism of action of Zincpyrithione and that the peptide P18 is effective against *M. furfur* even after short incubation times.

Example 46

Effect of P18 Variants

The inhibitory effect of the following P18 variants against *M. furfur* was analyzed:

```
H-KWKLFKKIPKFLHLAKKF-NH2    (P18; carboxy-terminal end amidated;
                             SEQ ID NO: 3)

H-KWKLFKKIPKFLHLAKKF-OH     (P18-OH; carboxy-terminal end not modified;
                             SEQ ID NO: 3)

H-PKWKLFKKIPKFLHLAKKFD-OH   (P18AC-OH; carboxy-terminal end not modified;
                             SEQ ID NO: 4734)

H-PKWKLFKKIPKFLHLAKKFN-NH2  (P18AC-NH2; carboxy-terminal end amidated;
                             SEQ ID NO: 4738)
```

The experiments were carried out as follows:
Growth medium: M472-Pityrosporum medium according to DSMZ
40 g/L malt extract
20 g/L ox bile
10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 100 μl of M472-Pityrosporum medium and inoculated with *M. furfur* suspension of the overnight culture. The *M. furfur* suspension was adjusted at the start of the experiment to an optical density, measured at 600 nm, of 0.1.

The peptide variants were dissolved in Dimethylsulfoxide (DMSO) with a final concentration of 1 mM. Optionally, DMSO can be omitted and a pure aqueous peptide solution can be used instead. 5 μl of said solution were added to 100 μl of *M. furfur* suspension (peptide P18 having a final concentration of 50 μM). In a reference mixture the same amount of DMSO containing no peptide P18 was added.

The microtiter plate was incubated with shaking at 30° C.

After 24 hours, the colony-forming units (CFU were determined by plating out 10 μl from each of the suspensions and, after incubation for 6 days, counting the colonies. Two independent experiments with in each case three identical mixtures were carried out and the number of colony-forming units was averaged.

TABLE 13

Averaged number of colony-forming units (CFU) after incubation of *M. furfur* with 50 μM of different P18 variants

| mixtures | CFU |
|---|---|
| *M. furfur* suspension without additives | 1377 |
| suspension + DMSO | 150 |
| suspension + DMSO + P18 | 0 |
| suspension + DMSO + P18-OH | 3 |
| suspension + DMSO + P18AC-OH | 37 |

The experiment shows that the solvent DMSO per se already reduces the CFU. However, all P18 variants show an increased inhibitory effect against *M. furfur* as compared to DMSO, with effectiveness increasing in the order P18AC-OH; P18-OH; P18. Following the same order, the number of negatively charged carboxylic groups decreases in the peptide molecule. It can therefore be concluded that peptide variants carrying a weak negative charge are most effective.

Example 47

Kinetics of the Effect of the Peptide P18 on *M. furfur* in the Presence of a Shampoo Basic Formulation The effect of the peptide P18 (H-KWKLFKKIPK-FLHLAKKF-NH$_2$; carboxy-terminal end amidated; SEQ ID NO: 3) as compared to Zincpyrithione and Climbazole was tested in the presence of the shampoo basic formulation and at different incubation times (table 14). The experiments were carried out as follows:

The following shampoo basic formulation was prepared:

TABLE 14 composition of the shampoo basic formulation

| Trade name (INCI) | Shampoo basic fomulation 31-3 |
|---|---|
| Texapon NSO (Sodium Laureth Sulfate) | 20% |
| Tego Betain L7 (Cocamidopropyl Betaine) | 20% |

The components Texapon NSO and Tego Betain L7 were mixed and dissolved. The pH was adjusted to pH 6-7 with NaOH.

The effect of P18, ZPT and Climbazole against *M. furfur* was analyzed as follows:

Growth medium: M472-Pityrosporum medium according to DSMZ
40 g/L malt extract
20 g/L ox bile
10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 100 μl of M472-Pityrosporum medium and inoculated with *M. furfur* suspension of the overnight culture. The *M. furfur* suspension was adjusted at the start of the experiment to an optical density, measured at 600 nm, of 0.1. 10% (v/v) of shampoo basic formulation 31-3 were added to the *M. furfur* suspension (see table 14).

The peptide P18 was dissolved in water with a concentration of 230 g/l. The active ingredients Zincpyrithione and Climbazole were dissolved in DMSO with a concentration of 230 g/l, with the active ingredients partially remaining insolubly suspended. The peptide solution and the active ingredient solutions, respectively, were added to the *M. furfur* suspension containing shampoo basic formulation, with a final concentration of 2.3 g/l; 1.15 g/l; 0.46 g/l and 0.23 g/l.

The microtiter plate was incubated with shaking at 30° C. After incubation of the mixtures for 5 min; 10 min; 20 min; 60 min and 24 hours, the colony-forming units were determined by plating out 1 μl from each of the suspensions and, after incubation for 6 days, counting the colonies.

It was observed that in this test P18 shows superior characteristics as compared to Zincpyrithione or Climbazole.

Example 48

Long-Term Stability of the Peptide P18 in Shampoo Basic Formulations Tested on *M. furfur*

Long-term stability of the peptide P18 (H-KWKLFKKIPKFLHLAKKF-NH$_2$; carboxy-terminal end amidated) in shampoo basic formulations was tested.

The following shampoo basic formulations were prepared:

TABLE 15

| | Composition of the formulations | | |
|---|---|---|---|
| Trade name (INCI) | formulation 31-1-10 | formulation 31-3-5 | formulation 31-3-2 |
| Texapon NSO (Sodium Laureth Sulfate) | 40% | 20% | 20% |
| Tego Betain L7 (Cocamidopropyl Betaine) | 10% | 20% | 20% |
| peptide P18 | 10 mM | 5 mM | 2 mM |

The components Texapon NSO and Tego Betain L7 were mixed and dissolved. The pH was adjusted to pH 6-7 with NaOH. In the following, 100 mM of aqueous P18 peptide solution were prepared. A corresponding volume of 100 mM P18 peptide solution was added to each formulation in order to obtain peptide P18 final concentrations as indicated in table 15.

The formulations were stored at 40° C.

After 0; 12 and 22 days, the effect of the formulations against *M. furfur* was analyzed.

Growth medium: M472-Pityrosporum medium according to DSMZ
40 g/L malt extract
20 g/L ox bile
10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 100 μl of M472-Pityrosporum medium and inoculated with *M. furfur* suspension of the overnight culture. The *M. furfur* suspension was adjusted at the start of the experiment to an optical density, measured at 600 nm, of 0.1.

10% (v/v) of the stored formulations 31-1-10; 31-3-5; 31-3-2 (table 15) were added to the *M. furfur* suspension.

The microtiter plate was incubated with shaking at 30° C. After 24 hours, the colony-forming units (CFU) were determined. For this, 1 μl and 10 μl were plated out from each of the suspensions and, after incubation for 6 days, the colonies were counted.

It was observed that P18 shows stable characteristics at the tested conditions.

Example 49

Determining the Minimum Inhibitory Concentration (MIC) of P18 Peptide in the Presence of a Shampoo Basic Formulation The minimum inhibitory concentration (MIC) of the peptide P18 (H-KWKLFKKIPKFLHLAKKF-NH$_2$; carboxy-terminal end amidated; SEQ ID NO: 3) in the presence of the shampoo basic formulation 31-3 (table 16) was tested as follows:

The following shampoo basic formulation was prepared:

TABLE 16 composition of the shampoo basic formulation

| Trade name (INCI) | shampoo basic formulation 31-3 containing P18 as ingredient |
| --- | --- |
| Texapon NSO (Sodium Laureth Sulfate) | 20% |
| Tego Betain L7 (Cocamidopropyl Betaine) | 20% |

The shampoo basic formulation was prepared by mixing and dissolving the components Texapon NSO and Tego Betain L7. The pH was adjusted to pH 6-7 with NaOH.

The effect of the peptide against *M. furfur* was analyzed as follows:

Growth medium: M472-Pityrosporum medium according to DSMZ
40 g/L malt extract
20 g/L ox bile
10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 170 µl of M472-Pityrosporum medium and inoculated with 10 µl of *M. furfur* suspension of the overnight culture. This corresponded to an optical density of 0.02-0.1, measured at 620 nm. 20 µl of shampoo basic formulation 31-3 were added to this mixture. Peptide P18 was dissolved in DMSO with a concentration of 10 mM. Corresponding amounts of P18 solution were added in order to obtain final concentrations as indicated in table 17.

The microtiter plate was incubated with shaking at 30° C. After incubation for 24 hours, the colony-forming units (CFU) were determined by resuspending 1 µl of each of the suspensions in 10 µl of medium and then plating out the obtained suspensions. After incubation for 6 days, the colonies on the plate were counted. The experiment was carried out in double determination.

TABLE 17

Counting the colony-forming units (CFU) after 24 hours of incubation

| P18 concentration | CFU |
| --- | --- |
| 0 µM | 538 |
| 25 µM | 80 |
| 50 µM | 32 |
| 100 µM | 0 |
| 200 µM | 0 |
| 300 µM | 0 |
| 400 µM | 0 |
| 500 µM | 0 |

The results show that growth of *M. furfur* is completely inhibited by P18 concentrations above 100 µM. The minimum inhibitory concentration in the presence of shampoo basic formulation 31-3 is therefore between 50 µM and 100 µM. This shows that the antifungal effect of the peptide P18 is maintained in this formulation, even though, as compared to mixtures containing no shampoo formulation (see example 41), the activity is slightly reduced by the shampoo basic formulation used.

Example 50

Combination of the Peptide P18 with Conventional Fungicidal Active Ingredients

The effect of combinations of active ingredients comprising proportions of the conventional fungicidal active ingredient Zincpyrithion, Ketoconazole or Climbazole and of the peptide P18 (H-KWKLFKKIPKFLHLAKKF-NH$_2$; carboxy-terminal end amidated; SEQ ID NO: 3) was tested in aqueous solution and in the presence of shampoo formulation 31-3 as follows:

The following shampoo basic formulation was prepared:

TABLE 18

Composition of the shampoo basic formulation:

| Trade name (INCI) | shampoo basic formulation 31-3 |
| --- | --- |
| Texapon NSO (Sodium Laureth Sulfate) | 20% |
| Tego Betain L7 (Cocamidopropyl Betaine) | 20% |

The shampoo basic formulation was prepared by mixing and dissolving the components Texapon NSO and Tego Betain L7. The pH was adjusted to pH 6-7 with NaOH.

The effect of the peptide P18 and of said conventional agents against *M. furfur* was analyzed as follows:

Growth medium: M472-Pityrosporum medium according to DSMZ
40 g/L malt extract
20 g/L ox bile
10 g/L Tween 40

The components were sterilized at 121° C., 1 bar superatmospheric pressure for 20 minutes.

2 g/L of olive oil (sterilized by filtration and, after autoclaving, added to the other components)

Since it was a two-phase medium, the complete medium was treated with sonication in order to enlarge the phase boundary.

For agar plates, if appropriate, 150 g/L of agar agar were added to the medium.

The growth test was carried out as follows: A shake flask with M472-Pityrosporum medium was inoculated with *M. furfur* and incubated with shaking overnight at 30° C. and 200 rpm.

A 96-well microtiter plate was filled with in each case 170 µl of M472-Pityrosporum medium and inoculated with 10 µl of *M. furfur* suspension of the overnight culture. This corresponded to an optical density of 0.02-0.1, measured at 620 nm. 20 µl of shampoo basic formulation 31-3 or alternatively water were added to this mixture. The peptide P18 was dissolved in water with a concentration of 10 mM. The conventional fungicidal active ingredient was dissolved in DMSO with a concentration of 10 mM. Corresponding amounts of P18 solution and conventional fungicidal active ingredient solution were added to the mixtures in order to obtain final concentrations as indicated in table 19.

TABLE 19

Concentrations of conventional fungicidal active ingredients and P18

| Mixture no. | conventional fungicidal active ingredient concentration | P18 concentration [µM] |
|---|---|---|
| 1 | 500 µM Zincpyrithione | 1000 |
| 2 | 500 µM Zincpyrithione | 200 |
| 3 | 500 µM Zincpyrithione | 50 |
| 4 | 500 µM Zincpyrithione | 0 |
| 5 | 100 µM Zincpyrithione | 1000 |
| 6 | 100 µM Zincpyrithione | 200 |
| 7 | 100 µM Zincpyrithione | 50 |
| 8 | 100 µM Zincpyrithione | 0 |
| 9 | 20 µM Zincpyrithione | 1000 |
| 10 | 20 µM Zincpyrithione | 200 |
| 11 | 20 µM Zincpyrithione | 50 |
| 12 | 20 µM Zincpyrithione | 0 |
| 13 | 0 µM Zincpyrithione | 1000 |
| 14 | 0 µM Zincpyrithione | 200 |
| 15 | 0 µM Zincpyrithione | 50 |
| 16 | 0 µM Zincpyrithione | 0 |
| 17 | 500 µM Ketoconazole | 1000 |
| 18 | 500 µM Ketoconazole | 200 |
| 19 | 500 µM Ketoconazole | 50 |
| 20 | 500 µM Ketoconazole | 0 |
| 21 | 100 µM Ketoconazole | 1000 |
| 22 | 100 µM Ketoconazole | 200 |
| 23 | 100 µM Ketoconazole | 50 |
| 24 | 100 µM Ketoconazole | 0 |
| 25 | 20 µM Ketoconazole | 1000 |
| 26 | 20 µM Ketoconazole | 200 |
| 27 | 20 µM Ketoconazole | 50 |
| 28 | 20 µM Ketoconazole | 0 |
| 29 | 0 µM Ketoconazole | 1000 |
| 30 | 0 µM Ketoconazole | 200 |
| 31 | 0 µM Ketoconazole | 50 |
| 32 | 0 µM Ketoconazole | 0 |
| 33 | 500 µM Climbazole | 1000 |
| 34 | 500 µM Climbazole | 200 |
| 35 | 500 µM Climbazole | 50 |
| 36 | 500 µM Climbazole | 0 |
| 37 | 100 µM Climbazole | 1000 |
| 38 | 100 µM Climbazole | 200 |
| 39 | 100 µM Climbazole | 50 |
| 40 | 100 µM Climbazole | 0 |
| 41 | 20 µM Climbazole | 1000 |
| 42 | 20 µM Climbazole | 200 |
| 43 | 20 µM Climbazole | 50 |
| 44 | 20 µM Climbazole | 0 |
| 45 | 0 µM Climbazole | 1000 |
| 46 | 0 µM Climbazole | 200 |
| 47 | 0 µM Climbazole | 50 |
| 48 | 0 µM Climbazole | 0 |

The microtiter plate was incubated with shaking at 30° C.

After incubation for 24 hours, the colony-forming units (CFU) were determined by resuspending 1 µl of each of the suspensions in 10 µl of medium and then plating out the obtained suspensions. After incubation for 6 days, the colonies on the plate were counted. It turns out that combinations of P18 with conventional fungicidal active ingredients show superior characteristics as compared to conventional fungicidal active ingredients taken alone.

4. Formulation Examples B

Cosmetic antidandruff shampoo preparations comprising the peptide P18 are described below. The peptide P18 is specified in the examples below by way of representation of all of the other peptides described above. It will be appreciated by the person skilled in the art that all of the other specified peptides according to the invention can also be used in the preparations given below.

The peptide P18 can be the sole active ingredient contained in the preparations or it can be used in combination with other antidandruff active ingredients (see description).

Example 51

| Ingredients (INCI) | 1 % | 2 % | 3 % | 4 % |
|---|---|---|---|---|
| A Ammonium Laureth Sulfate | 8.7 | 8.7 | 8.7 | 8.7 |
| Ammonium Lauryl Sulfate | 7.2 | 7.2 | 7.2 | 7.2 |
| Glycol Distearate | 1.5 | 1.5 | 1.5 | 1.5 |
| Dimethicone | 1.2 | 1.2 | 1.2 | 1.2 |
| Peptide P18 | 0.05 | 0.3 | 0.05 | 0.3 |
| Zinc Pyrithione | 0 | 0 | 1 | 0.7 |
| Ammonium Xylenesulfonate | 0.8 | 0.8 | 0.8 | 0.8 |
| Cetyl Alcohol | 0.7 | 0.7 | 0.7 | 0.7 |
| Cocamide MEA | 0.6 | 0.6 | 0.6 | 0.6 |
| Hydrogenated Polydecene | 0.5 | 0.5 | 0.5 | 0.5 |
| Polyquaternium-10 | 0.4 | 0.4 | 0.4 | 0.4 |
| PEG-7M | 0.3 | 0.3 | 0.3 | 0.3 |
| Panthenol | 0.3 | 0.3 | 0.3 | 0.3 |
| Panthenyl Ethyl Ether | 0.3 | 0.3 | 0.3 | 0.3 |
| Methyl Tyrosinate HCl | 0.2 | 0.2 | 0.2 | 0.2 |
| Histidine | 0.15 | 0.15 | 0.15 | 0.15 |
| Trimethylolpropane Tricaprylate/Tricaprate | 0.15 | 0.15 | 0.15 | 0.15 |
| Lysine HCl | 0.1 | 0.1 | 0.1 | 0.1 |
| Sodium Polynaphthalenesulfonate | 0.1 | 0.1 | 0.1 | 0.1 |
| Tocopherol | 0.1 | 0.1 | 0.1 | 0.1 |
| Aqua | ad 100 | ad 100 | ad 100 | ad 100 |
| Preservative | q.s. | q.s. | q.s. | q.s. |
| Parfum | q.s. | q.s. | q.s. | q.s. |
| Tetrasodium EDTA | q.s. | q.s. | q.s. | q.s. |
| Sodium Chloride | q.s. | q.s. | q.s. | q.s. |
| B Citric Acid | q.s. | q.s. | q.s. | q.s. |
| Sodium Citrate | q.s. | q.s. | q.s. | q.s. |

Preparation: Mix and dissolve the components of phase A. Adjust the pH to pH 5-7 with phase B. Viscosity can be adjusted through Tetrasodium EDTA and/or Sodium Chloride. Preferred viscosity is between 5000-15000 mPas.

Example 52

| | Ingredients (INCI) | 1 % | 2 % | 3 % | 4 % |
|---|---|---|---|---|---|
| A | Sodium Laureth Sulfate | 9 | 9 | 9 | 9 |
| | Cocamidopropyl Betaine | 6 | 6 | 6 | 6 |
| | Sodium Chloride | 3 | 3 | 3 | 3 |
| | PEG-3 Distearate | 1.5 | 1.5 | 1.5 | 1.5 |
| | Propylene Glycol | 1.5 | 1.5 | 1.5 | 1.5 |
| | Zinc Pyrithione | 0 | 0 | 1 | 0.7 |
| | Piroctone Olamine | 0 | 0 | 0.8 | 0.6 |
| | Climbazolee | 0 | 0 | 0.5 | 0.3 |
| | Peptid P18 | 0.05 | 0.3 | 0.05 | 0.3 |
| | Guar Hydroxypropyltrimonium Chloride | 0.2 | 0.2 | 0.2 | 0.2 |
| | Panthenol | 0.3 | 0.3 | 0.3 | 0.3 |
| | Sodium Polynaphthalenesulfonate | 0.2 | 0.2 | 0.2 | 0.2 |
| | Glucose | 0.2 | 0.2 | 0.2 | 0.2 |
| | Tocopherol | 0.1 | 0.1 | 0.1 | 0.1 |
| | Aqua | ad 100 | ad 100 | ad 100 | ad 100 |
| | Acrylates/Beheneth-25 Methacrylate Copolymer | q.s. | q.s. | q.s. | q.s. |
| | Cellulose Gum | q.s. | q.s. | q.s. | q.s. |
| | Parfum | q.s. | q.s. | q.s. | q.s. |
| | Preservative | q.s. | q.s. | q.s. | q.s. |
| B | Sodium Citrate | q.s. | q.s. | q.s. | q.s. |
| | Lactic Acid | q.s. | q.s. | q.s. | q.s. |

Preparation: Mix and dissolve components of phase A. Adjust the pH to pH 5-7 with phase B. Viscosity can be adjusted through Cellulose Gum and/or Acrylates/Beheneth-25 Methacrylate Copolymer. Preferred viscosity is between 5000-15000 mPas.

Example 53

| | Ingredients (INCI) | 1 % | 2 % | 3 % | 4 % |
|---|---|---|---|---|---|
| A | Sodium Laureth Sulfate | 7 | 7 | 7 | 7 |
| | Disodium Laureth Sulfosuccinate | 5.5 | 5.5 | 5.5 | 5.5 |
| | Cocamidopropyl Betaine | 3 | 3 | 3 | 3 |
| | Glycerin | 1.5 | 1.5 | 1.5 | 1.5 |
| | Zinc Pyrithione | 0 | 0 | 1 | 0.7 |
| | Zinc Sulfate | 0 | 0 | 0.7 | 0.5 |
| | Peptid P18 | 0.05 | 0.3 | 0.05 | 0.3 |
| | Sodium Chloride | 0.8 | 0.8 | 0.8 | 0.8 |
| | Dimethiconol | 0.8 | 0.8 | 0.8 | 0.8 |
| | PPG-12 | 0.8 | 0.8 | 0.8 | 0.8 |
| | Guar Hydroxypropyltrimonium Chloride | 0.3 | 0.3 | 0.3 | 0.3 |
| | TEA-Dodecylbenzenesulfonate | 0.4 | 0.4 | 0.4 | 0.4 |
| | Sodium Polynaphthalenesulfonate | 0.1 | 0.1 | 0.1 | 0.1 |
| | Ascorbyl Palmitate | 0.15 | 0.15 | 0.15 | 0.15 |
| | Tocopherol | 0.1 | 0.1 | 0.1 | 0.1 |
| | Lysine HCl | 0.15 | 0.15 | 0.15 | 0.15 |
| | Aqua | ad 100 | ad 100 | ad 100 | ad 100 |
| | Parfum | q.s. | q.s. | q.s. | q.s. |
| | Carbomer | q.s. | q.s. | q.s. | q.s. |
| | Preservative | q.s. | q.s. | q.s. | q.s. |
| B | Sodium Hydroxide | q.s. | q.s. | q.s. | q.s. |
| | Citric Acid | q.s. | q.s. | q.s. | q.s. |

Preparation: Mix and dissolve components of phase A. Adjust the pH to pH 5-7 with phase B. Viscosity can be adjusted through Carbomer and/or Sodium Hydroxide. Preferred viscosity is between 5000-15000 mPas.

Example 54

| | Ingredients (INCI) | 1 % | 2 % | 3 % | 4 % |
|---|---|---|---|---|---|
| A | Ammonium Lauryl Sulfate | 8.1 | 8.1 | 8.1 | 8.1 |
| | Ammonium Laureth Sulfate | 5.8 | 5.8 | 5.8 | 5.8 |
| | Cocamide MEA | 4 | 4 | 4 | 4 |
| | Cocamidopropyl Betaine | 2.3 | 2.3 | 2.3 | 2.3 |
| | Dimethiconol | 1 | 1 | 1 | 1 |
| | PEG-5 Cocamide | 0.95 | 0.95 | 0.95 | 0.95 |
| | Zinc Pyrithione | 0 | 0 | 0.5 | 0.3 |
| | Peptid P18 | 0.05 | 0.3 | 0.05 | 0.3 |
| | Glycol Distearate | 0.5 | 0.5 | 0.5 | 0.5 |
| | PPG-9 | 0.7 | 0.7 | 0.7 | 0.7 |
| | Guar Hydroxypropyltrimonium Chloride | 0.25 | 0.25 | 0.25 | 0.25 |
| | TEA-Dodecylbenzenesulfonate | 0.3 | 0.3 | 0.3 | 0.3 |
| | Ammonium Chloride | 0.2 | 0.2 | 0.2 | 0.2 |
| | Ammonium Xylenesulfonate | 0.1 | 0.1 | 0.1 | 0.1 |
| | Aqua | ad 100 | ad 100 | ad 100 | ad 100 |
| | Carbomer | q.s. | q.s. | q.s. | q.s. |
| | Preservative | q.s. | q.s. | q.s. | q.s. |
| | Parfum | q.s. | q.s. | q.s. | q.s. |

Preparation: Mix and dissolve components of phase A. Adjust the pH to pH 5-7 with phase B. Viscosity can be adjusted through Carbomer. Preferred viscosity is between 5000-15000 mPas.

Example 55

| | Ingredients (INCI) | 1 % | 2 % | 3 % | 4 % |
|---|---|---|---|---|---|
| A | Sodium Myreth Sulfate | 7.4 | 7.4 | 7.4 | 7.4 |
| | Sodium Laureth Sulfate | 6.1 | 6.1 | 6.1 | 6.1 |
| | Cocamidopropyl Betaine | 4.3 | 4.3 | 4.3 | 4.3 |
| | Disodium PEG-5 Laurylcitrate Sulfosuccinate | 3.4 | 3.4 | 3.4 | 3.4 |
| | PEG-3 Distearate | 1.5 | 1.5 | 1.5 | 1.5 |
| | PEG-40 Hydrogenated Castor Oil | 0.1 | 0.1 | 0.1 | 0.1 |
| | Tetrasodium Iminodisuccinate | 0.6 | 0.6 | 0.6 | 0.6 |
| | Peptid P18 | 0.05 | 0.3 | 0.05 | 0.3 |
| | Piroctone Olamine | 0 | 0 | 1 | 0.7 |
| | Polyquaternium-10 | 0.2 | 0.2 | 0.2 | 0.2 |
| | Sodium Chloride | 0.8 | 0.8 | 0.8 | 0.8 |
| | Panthenol | 0.4 | 0.4 | 0.4 | 0.4 |
| | Guar Hydroxypropyltrimonium Chloride | 0.7 | 0.7 | 0.7 | 0.7 |
| | Oryzanol | 0.3 | 0.3 | 0.3 | 0.3 |
| | Aqua | ad 100 | ad 100 | ad 100 | ad 100 |
| | Parfum | q.s. | q.s. | q.s. | q.s. |
| | Preservatives | q.s. | q.s. | q.s. | q.s. |
| B | Citric Acid | q.s. | q.s. | q.s. | q.s. |

Preparation: Mix and dissolve components of phase A. Adjust the pH to pH 5-7 with phase B. Preferred viscosity is between 5000-15000 mPas.

Example 56

| | Ingredients (INCI) | 1 % | 2 % | 3 % | 4 % |
|---|---|---|---|---|---|
| A | Sodium Laureth Sulfate | 11 | 11 | 11 | 11 |
| | Cocamidopropyl Betaine | 6 | 6 | 6 | 6 |
| | PEG-3 Distearate | 2 | 2 | 2 | 2 |
| | Peptid P18 | 0.05 | 0.3 | 0.05 | 0.3 |
| | Piroctone Olamine | 0 | 0 | 1 | 0.7 |
| | Polyquaternium-10 | 0.2 | 0.2 | 0.2 | 0.2 |
| | PEG-40 Hydrogenated Castor Oil | 0.2 | 0.2 | 0.2 | 0.2 |
| | Sodium Chloride | 0.8 | 0.8 | 0.8 | 0.8 |
| | Propylene Glycol | 0.4 | 0.4 | 0.4 | 0.4 |
| | Trideceth-9 | 0.6 | 0.6 | 0.6 | 0.6 |
| | Aqua | ad 100 | ad 100 | ad 100 | ad 100 |
| | Parfum | q.s. | q.s. | q.s. | q.s. |
| | Preservatives | q.s. | q.s. | q.s. | q.s. |
| B | Citric Acid | q.s. | q.s. | q.s. | q.s. |

Preparation: Mix and dissolve components of phase A. Adjust the pH to pH 5-7 with phase B. Preferred viscosity is between 5000-15000 mPas.

Example 57

| | Ingredients (INCI) | 1 % | 2 % | 3 % | 4 % |
|---|---|---|---|---|---|
| A | Alcohol denat. | 3 | 3 | 3 | 3 |
| | VP/VA Copolymer | 2.9 | 2.9 | 2.9 | 2.9 |
| | PEG 32 | 1.5 | 1.5 | 1.5 | 1.5 |
| | PEG-40 Hydrogenated Castor Oil | 0.1 | 0.1 | 0.1 | 0.1 |
| | Amino Methyl Propanol | 0.4 | 0.4 | 0.4 | 0.4 |
| | PEG-12 Dimethicone | 0.2 | 0.2 | 0.2 | 0.2 |
| | Panthenol | 0.3 | 0.3 | 0.3 | 0.3 |
| | Peptid P18 | 0.05 | 0.3 | 0.05 | 0.3 |
| | Piroctone Olamine | 0 | 0 | 1 | 0.7 |
| | Benzophenone-4 | 0.05 | 0.05 | 0.05 | 0.05 |
| | VP/Methacrylamide/Vinyl Imidazole Copolymer | 0.9 | 0.9 | 0.9 | 0.9 |
| | Aqua | ad 100 | ad 100 | ad 100 | ad 100 |
| | Preservatives | q.s. | q.s. | q.s. | q.s. |
| | Parfum | q.s. | q.s. | q.s. | q.s. |
| | Carbomer | q.s. | q.s. | q.s. | q.s. |

Preparation: Mix and dissolve components of phase A. Adjust the pH to pH 5-7 with phase B. Viscosity can be adjusted through Carbomer. Preferred viscosity is between 5000-15000 mPas.

Example 58

| | Ingredients (INCI) | 1 % | 2 % | 3 % | 4 % |
|---|---|---|---|---|---|
| A | Sodium Laureth Sulfate | 13 | 13 | 13 | 13 |
| | Disodium Cocoamphodiacetate | 3.3 | 3.3 | 3.3 | 3.3 |
| | Sodium Chloride | 1.2 | 1.2 | 1.2 | 1.2 |
| | Glycol Distearate | 0.7 | 0.7 | 0.7 | 0.7 |
| | Peptid P18 | 0.05 | 0.3 | 0.05 | 0.3 |
| | Climbazole | 0 | 0 | 0.5 | 0.3 |
| | PEG-7 Glyceryl Cocoate | 0.2 | 0.2 | 0.2 | 0.2 |
| | Salicylic Acid | 0.4 | 0.4 | 0.4 | 0.4 |
| | Styrene/Acrylates Copolymer | 0.36 | 0.36 | 0.36 | 0.36 |
| | Laureth-4 | 0.2 | 0.2 | 0.2 | 0.2 |
| | Panthenol | 0.3 | 0.3 | 0.3 | 0.3 |
| | PEG-40 Hydrogenated Castor Oil | 0.3 | 0.3 | 0.3 | 0.3 |
| | Hydrogenated Castor Oil | 0.6 | 0.6 | 0.6 | 0.6 |
| | Cocamidopropyl Betaine | 0.9 | 0.9 | 0.9 | 0.9 |
| | Polyquaternium-10 | 0.3 | 0.3 | 0.3 | 0.3 |
| | Glycerin | 0.8 | 0.8 | 0.8 | 0.8 |
| | Aqua | ad 100 | ad 100 | ad 100 | ad 100 |
| | Preservatives | q.s. | q.s. | q.s. | q.s. |
| | Parfum | q.s. | q.s. | q.s. | q.s. |
| B | Citric Acid | q.s. | q.s. | q.s. | q.s. |

Preparation: Mix and dissolve components of phase A. Adjust the pH to pH 5-7 with phase B. Preferred viscosity is between 5000-15000 mPas.

Example 59

| | Ingredients (INCI) | 1 % | 2 % | 3 % | 4 % |
|---|---|---|---|---|---|
| A | Sodium Laureth Sulfate | 11 | 11 | 11 | 11 |
| | Coco-Betaine | 5 | 5 | 5 | 5 |
| | Dimethicone | 0.9 | 0.9 | 0.9 | 0.9 |
| | Cetyl Alcohol | 0.4 | 0.4 | 0.4 | 0.4 |
| | Hydroxystearyl Cetyl Ether | 0.4 | 0.4 | 0.4 | 0.4 |
| | Sodium Chloride | 0.3 | 0.3 | 0.3 | 0.3 |
| | Cocamide MIPA | 0.4 | 0.4 | 0.4 | 0.4 |
| | Polyquaternium 10 | 0.3 | 0.3 | 0.3 | 0.3 |
| | Propylene Glycol | 0.3 | 0.3 | 0.3 | 0.3 |
| | Pyridoxine HCL | 0.1 | 0.1 | 0.1 | 0.1 |
| | Peptid P18 | 0.05 | 0.3 | 0.05 | 0.3 |
| | Zinc Pyrithione | 0 | 0 | 1 | 0.7 |
| | Aqua | ad 100 | ad 100 | ad 100 | ad 100 |
| | Preservatives | q.s. | q.s. | q.s. | q.s. |
| | Carbomer | q.s. | q.s. | q.s. | q.s. |
| | Parfum | q.s. | q.s. | q.s. | q.s. |

Preparation: Mix and dissolve components of phase A. Adjust the pH to pH 5-7 with phase B. Viscosity can be adjusted through Carbomer. Preferred viscosity is between 5000-15000 mPas.

Example 60

| | Ingredients (INCI) | 1 % | 2 % | 3 % | 4 % |
|---|---|---|---|---|---|
| A | Sodium Laureth Sulfate | 13 | 13 | 13 | 13 |
| | Polysorbate (21) | 5 | 5 | 5 | 5 |
| | Dimethicone | 0.8 | 0.8 | 0.8 | 0.8 |
| | Cocamidopropyl Betaine | 0.9 | 0.9 | 0.9 | 0.9 |
| | Cetyl Alcohol | 0.4 | 0.4 | 0.4 | 0.4 |
| | Hexylene Glycol | 0.3 | 0.3 | 0.3 | 0.3 |
| | Guar Hydroxypropyltrimonium Chloride | 0.2 | 0.2 | 0.2 | 0.2 |
| | Cocamide MIPA | 0.5 | 0.5 | 0.5 | 0.5 |
| | Hydroxystearyl Cetyl Ether | 0.6 | 0.6 | 0.6 | 0.6 |
| | Sodium Chloride | 0.3 | 0.3 | 0.3 | 0.3 |
| | Propylene Glycol | 0.3 | 0.3 | 0.3 | 0.3 |
| | Peptid P18 | 0.05 | 0.3 | 0.05 | 0.3 |
| | Pyroctone Olamine | 0 | 0 | 1 | 0.7 |

| Ingredients (INCI) | 1 % | 2 % | 3 % | 4 % |
|---|---|---|---|---|
| Aqua | ad 100 | ad 100 | ad 100 | ad 100 |
| Preservatives | q.s. | q.s. | q.s. | q.s. |
| Carbomer | q.s. | q.s. | q.s. | q.s. |
| Parfum | q.s. | q.s. | q.s. | q.s. |

Preparation: Mix and dissolve components of phase A. Adjust the pH to pH 5-7 with phase B. Viscosity can be adjusted through Carbomer. Preferred viscosity is between 5000-15000 mPas.

Example 61

| | Ingredients (INCI) | 1 % | 2 % | 3 % | 4 % |
|---|---|---|---|---|---|
| A | Sodium Laureth Sulfate | 9 | 9 | 9 | 9 |
| | Disodium Cocoamphodiacetate | 6 | 6 | 6 | 6 |
| | Glycerin | 2.1 | 2.1 | 2.1 | 2.1 |
| | Glycol Distearate | 1.2 | 1.2 | 1.2 | 1.2 |
| | Sodium Chloride | 0.9 | 0.9 | 0.9 | 0.9 |
| | Sodium Laureth-8 Sulfate | 0.9 | 0.9 | 0.9 | 0.9 |
| | Hexylene Glycol | 0.3 | 0.3 | 0.3 | 0.3 |
| | Polyquaternium-10 | 0.1 | 0.1 | 0.1 | 0.1 |
| | Magnesium Laureth-8 Sulfate | 0.3 | 0.3 | 0.3 | 0.3 |
| | Propylene Glycol | 0.8 | 0.8 | 0.8 | 0.8 |
| | Magnesium Laureth Sulfate | 0.6 | 0.6 | 0.6 | 0.6 |
| | Sodium Oleth Laureth | 0.7 | 0.7 | 0.7 | 0.7 |
| | PEG-55 Propylene Glycol Oleate | 0.7 | 0.7 | 0.7 | 0.7 |
| | Peptid P18 | 0.05 | 0.3 | 0.05 | 0.3 |
| | Salicylic Acid | 0 | 0 | 0.5 | 0.3 |
| | Polyquaternium-30 | 0.35 | 0.35 | 0.35 | 0.35 |
| | Magnesium Oleth Sulfate | 0.65 | 0.65 | 0.65 | 0.65 |
| | 2-Oleamido-1,3-Octadecanediol | 0.4 | 0.4 | 0.4 | 0.4 |
| | Aqua | ad 100 | ad 100 | ad 100 | ad 100 |
| | Preservatives | q.s. | q.s. | q.s. | q.s. |
| | Carbomer | q.s. | q.s. | q.s. | q.s. |
| | Parfum | q.s. | q.s. | q.s. | q.s. |

Preparation: Mix and dissolve components of phase A. Adjust the pH to pH 5-7 with phase B. Viscosity can be adjusted through Carbomer. Preferred viscosity is between 5000-15000 mPas.

Example 62

| | Ingredients (INCI) | 1 % | 2 % | 3 % | 4 % |
|---|---|---|---|---|---|
| A | Sodium Laureth Sulfate | 10.5 | 10.5 | 10.5 | 10.5 |
| | Cocamidopropyl Betaine | 8 | 8 | 8 | 8 |
| | Glycerin | 3 | 3 | 3 | 3 |
| | Peptid P18 | 0.05 | 0.3 | 0.05 | 0.3 |
| | Zinc pyrithone | 0 | 0 | 1 | 0.7 |
| | PEG-55 Propylene Glycol Oleate | 0.7 | 0.7 | 0.7 | 0.7 |
| | Disodium ricinoleamido MEA-sulfosuccinate | 0.6 | 0.6 | 0.6 | 0.6 |
| | Propylene Glycol | 0.7 | 0.7 | 0.7 | 0.7 |
| | Glyceryl Laurate | 0.4 | 0.4 | 0.4 | 0.4 |
| | PPG-5-Ceteth-20 | 0.32 | 0.32 | 0.32 | 0.32 |
| | Acrylates Copolymer | 0.2 | 0.2 | 0.2 | 0.2 |
| | Disodium Cocoamphodipropionate | 0.54 | 0.54 | 0.54 | 0.54 |
| | Lecithin | 0.4 | 0.4 | 0.4 | 0.4 |

| | Ingredients (INCI) | 1 % | 2 % | 3 % | 4 % |
|---|---|---|---|---|---|
| | Aqua | ad 100 | ad 100 | ad 100 | ad 100 |
| | Preservatives | q.s. | q.s. | q.s. | q.s. |
| | Parfum | q.s. | q.s. | q.s. | q.s. |
| B | Phosphoric Acid | q.s. | q.s. | q.s. | q.s. |

Preparation: Mix and dissolve components of phase A. Adjust the pH to pH 5-7 with phase B. Preferred viscosity is between 5000-15000 mPas.

Example 63

| | Ingredients (INCI) | 1 % | 2 % | 3 % | 4 % |
|---|---|---|---|---|---|
| A | Sodium Laureth Sulfate | 9.3 | 9.3 | 9.3 | 9.3 |
| | Sodium Lauryl Sulfate | 7.6 | 7.6 | 7.6 | 7.6 |
| | Cocamide MEA | 1 | 1 | 1 | 1 |
| | Zinc Carbonate | 0.6 | 0.6 | 0.6 | 0.6 |
| | Glycol Distearate | 0.8 | 0.8 | 0.8 | 0.8 |
| | Peptid P18 | 0.05 | 0.3 | 0.05 | 0.3 |
| | Zinc Pyrithione | 0 | 0 | 1 | 0.7 |
| | Cetyl Alcohol | 0.36 | 0.36 | 0.36 | 0.36 |
| | Dimethicone | 0.42 | 0.42 | 0.42 | 0.42 |
| | Sodium Xylenesulfonate | 0.23 | 0.23 | 0.23 | 0.23 |
| | Magnesium Sulfate | 0.37 | 0.37 | 0.37 | 0.37 |
| | Ammonium Laureth Sulfate | 0.9 | 0.9 | 0.9 | 0.9 |
| | Sodium Diethylenetriamine Pentamethylene Phosphonate | 0.6 | 0.6 | 0.6 | 0.6 |
| | Etidronic Acid | 0.2 | 0.2 | 0.2 | 0.2 |
| | Sodium Polynaphthalenesulfonate | 0.35 | 0.35 | 0.35 | 0.35 |
| | Aqua | ad 100 | ad 100 | ad 100 | ad 100 |
| | Preservatives | q.s. | q.s. | q.s. | q.s. |
| | Sodium Chloride | q.s. | q.s. | q.s. | q.s. |
| | Magnesium Carbonate Hydroxide | q.s. | q.s. | q.s. | q.s. |
| | Tetrasodium EDTA | q.s. | q.s. | q.s. | q.s. |
| | Parfum | q.s. | q.s. | q.s. | q.s. |

Preparation: Mix and dissolve components of phase A. Adjust the pH to pH 5-7 with phase B. Viscosity can be adjusted through Tetrasodium EDTA and/or Sodium Chloride. Preferred viscosity is between 5000-15000 mPas.

Example 64

| | Ingredients (INCI) | 1 % | 2 % | 3 % | 4 % |
|---|---|---|---|---|---|
| A | Sodium Laureth Sulfate | 9.3 | 9.3 | 9.3 | 9.3 |
| | Sodium Lauryl Sulfate | 7.6 | 7.6 | 7.6 | 7.6 |
| | Cocamide MEA | 1 | 1 | 1 | 1 |
| | Zinc Carbonate | 0.6 | 0.6 | 0.6 | 0.6 |
| | Glycol Distearate | 0.8 | 0.8 | 0.8 | 0.8 |
| | Sodium Chloride | 0.7 | 0.7 | 0.7 | 0.7 |
| | Peptid P18 | 0.05 | 0.3 | 0.05 | 0.3 |
| | Zinc Pyrithione | 0 | 0 | 1 | 0.7 |
| | Dimethicone | 0.42 | 0.42 | 0.42 | 0.42 |
| | Cetyl Alcohol | 0.36 | 0.36 | 0.36 | 0.36 |
| | Sodium Xylenesulfonate | 0.23 | 0.23 | 0.23 | 0.23 |
| | Magnesium Sulfate | 0.37 | 0.37 | 0.37 | 0.37 |
| | Guar Hydroxypropyltrimonium Chloride | 0.3 | 0.3 | 0.3 | 0.3 |
| | Ammonium Laureth Sulfate | 0.9 | 0.9 | 0.9 | 0.9 |
| | Sodium Diethylenetriamine Pentamethylene Phosphonate | 0.6 | 0.6 | 0.6 | 0.6 |

-continued

| Ingredients (INCI) | 1 % | 2 % | 3 % | 4 % |
|---|---|---|---|---|
| Etidronic Acid | 0.2 | 0.2 | 0.2 | 0.2 |
| Paraffinum Liquidum | 0.3 | 0.3 | 0.3 | 0.3 |
| Tocopheryl Acetate | 0.3 | 0.3 | 0.3 | 0.3 |
| Aqua | ad 100 | ad 100 | ad 100 | ad 100 |
| Preservatives | q.s. | q.s. | q.s. | q.s. |
| Parfum | q.s. | q.s. | q.s. | q.s. |
| Magnesium Carbonate Hydroxide | q.s. | q.s. | q.s. | q.s. |
| Sodium Polynaphthalenesulfonate | q.s. | q.s. | q.s. | q.s. |

Preparation: Mix and dissolve components of phase A. Adjust the pH to pH 5-7 with phase B. Viscosity can be adjusted through Magnesium Carbonate Hydroxide and/or Sodium Polynaphthalenesulfonate. Preferred viscosity is between 5000-15000 mPas.

Example 65

| | Ingredients (INCI) | 1 % | 2 % | 3 % | 4 % |
|---|---|---|---|---|---|
| A | Ammonium Laureth Sulfate | 11.2 | 11.2 | 11.2 | 11.2 |
| | Ammonium Lauryl Sulfate | 8.6 | 8.6 | 8.6 | 8.6 |
| | Glycol Distearate | 0.8 | 0.8 | 0.8 | 0.8 |
| | Dimethicone | 0.9 | 0.9 | 0.9 | 0.9 |
| | Peptid P18 | 0.05 | 0.3 | 0.05 | 0.3 |
| | Zinc Pyrithione | 0 | 0 | 1 | 0.7 |
| | Cetyl Alcohol | 0.3 | 0.3 | 0.3 | 0.3 |
| | Ammonium Xylenesulphonate | 0.23 | 0.23 | 0.23 | 0.23 |
| | Cocamide MEA | 0.8 | 0.8 | 0.8 | 0.8 |
| | Hydrogenated Polydecene | 0.3 | 0.3 | 0.3 | 0.3 |
| | PEG-7M | 0.1 | 0.1 | 0.1 | 0.1 |
| | Trimethylolpropane Tricaprylate/Tricaprate | 0.2 | 0.2 | 0.2 | 0.2 |
| | Sodium Polynaphthalenesulphonate | 0.35 | 0.35 | 0.35 | 0.35 |
| | Tocopherol | 0.8 | 0.8 | 0.8 | 0.8 |
| | Aqua | ad 100 | ad 100 | ad 100 | ad 100 |
| | Preservatives | q.s. | q.s. | q.s. | q.s. |
| | Parfum | q.s. | q.s. | q.s. | q.s. |
| | Sodium Chloride | q.s. | q.s. | q.s. | q.s. |
| | Tetrasodium EDTA | q.s. | q.s. | q.s. | q.s. |
| B | Citric Acid | q.s. | q.s. | q.s. | q.s. |
| | Sodium citrate | q.s. | q.s. | q.s. | q.s. |

Preparation: Mix and dissolve components of phase A. Adjust the pH to pH 5-7 with phase B. Viscosity can be adjusted through Tetrasodium EDTA and/or Sodium Chloride. Preferred viscosity is between 5000-15000 mPas.

Example 66

| | Ingredients (INCI) | 1 % | 2 % | 3 % | 4 % |
|---|---|---|---|---|---|
| A | Ammonium Laureth Sulfate | 11.2 | 11.2 | 11.2 | 11.2 |
| | Ammonium Lauryl Sulfate | 8.6 | 8.6 | 8.6 | 8.6 |
| | Dimethicone | 1 | 1 | 1 | 1 |
| | Glycol Distearate | 0.8 | 0.8 | 0.8 | 0.8 |
| | Peptid P18 | 0.05 | 0.3 | 0.05 | 0.3 |
| | Zinc Pyrithione | 0 | 0 | 1 | 0.7 |
| | Cetyl Alcohol | 0.3 | 0.3 | 0.3 | 0.3 |
| | Cocamide MEA | 0.8 | 0.8 | 0.8 | 0.8 |
| | Hydrogenated Polydecene | 0.3 | 0.3 | 0.3 | 0.3 |
| | Trimethylolpropane Tricaprylate/tricaprate | 0.2 | 0.2 | 0.2 | 0.2 |
| | Ammonium Xylenesulfonate | 0.23 | 0.23 | 0.23 | 0.23 |
| | Sodium Polynapthalenesulfonate | 0.35 | 0.35 | 0.35 | 0.35 |
| | Aqua | ad 100 | ad 100 | ad 100 | ad 100 |
| | Preservatives | q.s. | q.s. | q.s. | q.s. |
| | Sodium Chloride | q.s. | q.s. | q.s. | q.s. |
| | Tetrasodium EDTA | q.s. | q.s. | q.s. | q.s. |
| | Parfum | q.s. | q.s. | q.s. | q.s. |
| B | Citric Acid | q.s. | q.s. | q.s. | q.s. |
| | Sodium citrate | q.s. | q.s. | q.s. | q.s. |

Preparation: Mix and dissolve components of phase A. Adjust the pH to pH 5-7 with phase B. Viscosity can be adjusted through Tetrasodium EDTA and/or Sodium Chloride. Preferred viscosity is between 5000-15000 mPas.

Unless otherwise stated the term P18 refers to a peptide of SEQ ID NO:3.

The disclosure of documents cited herein is incorporated by reference.

SEQUENCE LISTING (4742 sequences)

SEQ ID NO: 1 - protein, 19 aa, Artificial
  Sequence Motif 1
  MISC_FEATURE (1)..(1): Xaa = basic amino acid or hydrophobic amino acid different from Pro
  MISC_FEATURE (2)..(2): Xaa = basic amino acid or hydrophobic amino acid different from Pro
  MISC_FEATURE (4)..(4): Xaa = basic amino acid or hydrophobic amino acid different from Pro
  MISC_FEATURE (5)..(5): Xaa = basic amino acid or hydrophobic amino acid different from Pro
  MISC_FEATURE (6)..(6): Xaa = basic amino acid or hydrophobic amino acid different from Pro
  MISC_FEATURE (10)..(10): Xaa = missing or is Pro or Pro-Pro
  MISC_FEATURE (13)..(13): Xaa = basic amino acid or hydrophobic amino acid different from Pro
  MISC_FEATURE (14)..(14): Xaa = basic amino acid or hydrophobic amino acid different from Pro
  MISC_FEATURE (15)..(15): Xaa = basic amino acid or hydrophobic amino acid different from Pro
  MISC_FEATURE (17)..(17): Xaa = basic amino acid or hydrophobic amino acid different from Pro
XXKXXXKIPXKFXXXAXKF

SEQ ID NO: 2 - protein, 20 aa, Artificial
  Sequence Motif 2
  MISC_FEATURE (1)..(1): Xaa = Lys, Arg or Phe
  MISC_FEATURE (2)..(2): Xaa = Lys or Trp
  MISC_FEATURE (4)..(4): Xaa = Leu or Lys
  MISC_FEATURE (5)..(5): Xaa = Phe or Leu
  MISC_FEATURE (6)..(6): Xaa = Leu or Lys
  MISC_FEATURE (10)..(10): Xaa = Pro or missing
  MISC_FEATURE (11)..(11): Xaa = Pro or missing
  MISC_FEATURE (14)..(14): Xaa = Leu or Lys
  MISC_FEATURE (15)..(15): Xaa = His or Lys
  MISC_FEATURE (16)..(16): Xaa = Ala, Leu, Val or Ser
  MISC_FEATURE (18)..(18): Xaa = Leu or Lys
XXKXXXKIPXXKFXXXAXKF

SEQ ID NO: 3 - protein, 18 aa, Artificial
  P18 Peptide
  MOD_RES (18)..(18): AMIDATION
KWKLFKKIPKFLHLAKKF

SEQ ID NO: 4 - protein, 18 aa, Artificial
  RP18 Peptide
RWKLFKKIPKFLHLAKKF

SEQ ID NO: 5 - protein, 18 aa, Artificial
  KKFP18 Peptide
FKKLFKKIPKFLHAAKKF

SEQ ID NO: 6 - protein, 18 aa, Artificial
  KKLP18 Peptide
KWKLLKKIPKFKKLALKF

SEQ ID NO: 7 - protein, 18 aa, Artificial
  AP18 Peptide
KWKLFKKIPKFLHAAKKF

SEQ ID NO: 8 - protein, 18 aa, Artificial
  KFLP18 Peptide
KWKKFLKIPKFLHAAKKF

SEQ ID NO: 9 - protein, 18 aa, Artificial
  KLLP18 Peptide
KWKKLLKIPKFLHAAKKF

SEQ ID NO: 10 - protein, 20 aa, Artificial
  Short Peptide
  misc_feature (2)..(2): Xaa can be any naturally occurring amino acid
  misc_feature (4)..(6): Xaa can be any naturally occurring amino acid
  misc_feature (10)..(11): Xaa can be any naturally occurring amino acid
  misc_feature (16)..(16): Xaa can be any naturally occurring amino acid
KXKXXXKIPXXKFLHXAKKF

SEQ ID NO: 11 - protein, 20 aa, Artificial
  Short Peptide
KKKLFLKIPPPKFLHAALKF

SEQ ID NO: 12 - protein, 20 aa, Artificial
  Short Peptide
RKKLFLKIPPPKFLHAALKF

SEQ ID NO: 13 - protein, 20 aa, Artificial
  Short Peptide
FKKLFLKIPPPKFLHAALKF

SEQ ID NO: 14 - protein, 20 aa, Artificial
  Short Peptide
KWKLFLKIPPPKFLHAALKF

SEQ ID NO: 15 - protein, 20 aa, Artificial
  Short Peptide
RWKLFLKIPPPKFLHAALKF

SEQ ID NO: 16 - protein, 20 aa, Artificial
  Short Peptide
FWKLFLKIPPPKFLHAALKF

SEQ ID NO: 17 - protein, 20 aa, Artificial
  Short Peptide
KKKKFLKIPPPKFLHAALKF

SEQ ID NO: 18 - protein, 20 aa, Artificial
  Short Peptide
RKKKFLKIPPPKFLHAALKF

SEQ ID NO: 19 - protein, 20 aa, Artificial
  Short Peptide
FKKKFLKIPPPKFLHAALKF

SEQ ID NO: 20 - protein, 20 aa, Artificial
  Short Peptide
KWKKFLKIPPPKFLHAALKF

SEQ ID NO: 21 - protein, 20 aa, Artificial
  Short Peptide
RWKKFLKIPPPKFLHAALKF

SEQ ID NO: 22 - protein, 20 aa, Artificial
  Short Peptide
FWKKFLKIPPPKFLHAALKF

SEQ ID NO: 23 - protein, 20 aa, Artificial
  Short Peptide
KKKLLLKIPPPKFLHAALKF

SEQ ID NO: 24 - protein, 20 aa, Artificial
  Short Peptide
RKKLLLKIPPPKFLHAALKF

SEQ ID NO: 25 - protein, 20 aa, Artificial
  Short Peptide
FKKLLLKIPPPKFLHAALKF

SEQ ID NO: 26 - protein, 20 aa, Artificial
  Short Peptide
KWKLLLKIPPPKFLHAALKF

SEQ ID NO: 27 - protein, 20 aa, Artificial
  Short Peptide
RWKLLLKIPPPKFLHAALKF

SEQ ID NO: 28 - protein, 20 aa, Artificial
  Short Peptide
FWKLLLKIPPPKFLHAALKF

SEQ ID NO: 29 - protein, 20 aa, Artificial
  Short Peptide
KKKKLLKIPPPKFLHAALKF

SEQ ID NO: 30 - protein, 20 aa, Artificial
  Short Peptide
RKKKLLKIPPPKFLHAALKF

SEQ ID NO: 31 - protein, 20 aa, Artificial
  Short Peptide
FKKKLLKIPPPKFLHAALKF

SEQ ID NO: 32 - protein, 20 aa, Artificial
  Short Peptide
KWKKLLKIPPPKFLHAALKF

SEQ ID NO: 33 - protein, 20 aa, Artificial
  Short Peptide
RWKKLLKIPPPKFLHAALKF

SEQ ID NO: 34 - protein, 20 aa, Artificial
  Short Peptide
FWKKLLKIPPPKFLHAALKF

SEQ ID NO: 35 - protein, 20 aa, Artificial
  Short Peptide
KKKLFKKIPPPKFLHAALKF

SEQ ID NO: 36 - protein, 20 aa, Artificial
  Short Peptide
RKKLFKKIPPPKFLHAALKF

SEQ ID NO: 37 - protein, 20 aa, Artificial
  Short Peptide
FKKLFKKIPPPKFLHAALKF

SEQ ID NO: 38 - protein, 20 aa, Artificial
  Short Peptide
KWKLFKKIPPPKFLHAALKF

SEQ ID NO: 39 - protein, 20 aa, Artificial
  Short Peptide
RWKLFKKIPPPKFLHAALKF

SEQ ID NO: 40 - protein, 20 aa, Artificial
  Short Peptide
FWKLFKKIPPPKFLHAALKF

SEQ ID NO: 41 - protein, 20 aa, Artificial
  Short Peptide
KKKKFKKIPPPKFLHAALKF

SEQ ID NO: 42 - protein, 20 aa, Artificial
  Short Peptide
RKKKFKKIPPPKFLHAALKF

SEQ ID NO: 43 - protein, 20 aa, Artificial
  Short Peptide
FKKKFKKIPPPKFLHAALKF

SEQ ID NO: 44 - protein, 20 aa, Artificial
  Short Peptide
KWKKFKKIPPPKFLHAALKF

SEQ ID NO: 45 - protein, 20 aa, Artificial
  Short Peptide
RWKKFKKIPPPKFLHAALKF

SEQ ID NO: 46 - protein, 20 aa, Artificial
  Short Peptide
FWKKFKKIPPPKFLHAALKF

SEQ ID NO: 47 - protein, 20 aa, Artificial
  Short Peptide
KKKLLKKIPPPKFLHAALKF

SEQ ID NO: 48 - protein, 20 aa, Artificial
  Short Peptide
RKKLLKKIPPPKFLHAALKF

SEQ ID NO: 49 - protein, 20 aa, Artificial
  Short Peptide
FKKLLKKIPPPKFLHAALKF

SEQ ID NO: 50 - protein, 20 aa, Artificial
  Short Peptide
KWKLLKKIPPPKFLHAALKF

SEQ ID NO: 51 - protein, 20 aa, Artificial
  Short Peptide
RWKLLKKIPPPKFLHAALKF

SEQ ID NO: 52 - protein, 20 aa, Artificial
  Short Peptide
FWKLLKKIPPPKFLHAALKF

SEQ ID NO: 53 - protein, 20 aa, Artificial
  Short Peptide
KKKKLKKIPPPKFLHAALKF

SEQ ID NO: 54 - protein, 20 aa, Artificial
  Short Peptide
RKKKLKKIPPPKFLHAALKF

SEQ ID NO: 55 - protein, 20 aa, Artificial
  Short Peptide
FKKKLKKIPPPKFLHAALKF

SEQ ID NO: 56 - protein, 20 aa, Artificial
  Short Peptide
KWKKLKKIPPPKFLHAALKF

SEQ ID NO: 57 - protein, 20 aa, Artificial
  Short Peptide
RWKKLKKIPPPKFLHAALKF

SEQ ID NO: 58 - protein, 20 aa, Artificial
  Short Peptide
FWKKLKKIPPPKFLHAALKF

SEQ ID NO: 59 - protein, 19 aa, Artificial
  Short Peptide
KKKLFLKIPPKFLHAALKF

SEQ ID NO: 60 - protein, 19 aa, Artificial
  Short Peptide
RKKLFLKIPPKFLHAALKF

SEQ ID NO: 61 - protein, 19 aa, Artificial
  Short Peptide
FKKLFLKIPPKFLHAALKF

SEQ ID NO: 62 - protein, 19 aa, Artificial
  Short Peptide
KWKLFLKIPPKFLHAALKF

SEQ ID NO: 63 - protein, 19 aa, Artificial
  Short Peptide
RWKLFLKIPPKFLHAALKF

SEQ ID NO: 64 - protein, 19 aa, Artificial
  Short Peptide
FWKLFLKIPPKFLHAALKF

SEQ ID NO: 65 - protein, 19 aa, Artificial
  Short Peptide
KKKKFLKIPPKFLHAALKF

SEQ ID NO: 66 - protein, 19 aa, Artificial
  Short Peptide
RKKKFLKIPPKFLHAALKF

SEQ ID NO: 67 - protein, 19 aa, Artificial
  Short Peptide
FKKKFLKIPPKFLHAALKF

SEQ ID NO: 68 - protein, 19 aa, Artificial
  Short Peptide
KWKKFLKIPPKFLHAALKF

SEQ ID NO: 69 - protein, 19 aa, Artificial
  Short Peptide
RWKKFLKIPPKFLHAALKF

SEQ ID NO: 70 - protein, 19 aa, Artificial
  Short Peptide
FWKKFLKIPPKFLHAALKF

SEQ ID NO: 71 - protein, 19 aa, Artificial
  Short Peptide
KKKLLLKIPPKFLHAALKF

SEQ ID NO: 72 - protein, 19 aa, Artificial
  Short Peptide
RKKLLLKIPPKFLHAALKF

SEQ ID NO: 73 - protein, 19 aa, Artificial
  Short Peptide
FKKLLLKIPPKFLHAALKF

SEQ ID NO: 74 - protein, 19 aa, Artificial
  Short Peptide
KWKLLLKIPPKFLHAALKF

SEQ ID NO: 75 - protein, 19 aa, Artificial
  Short Peptide
RWKLLLKIPPKFLHAALKF

SEQ ID NO: 76 - protein, 19 aa, Artificial
  Short Peptide
FWKLLLKIPPKFLHAALKF

SEQ ID NO: 77 - protein, 19 aa, Artificial
  Short Peptide
KKKKLLKIPPKFLHAALKF

SEQ ID NO: 78 - protein, 19 aa, Artificial
  Short Peptide
RKKKLLKIPPKFLHAALKF

SEQ ID NO: 79 - protein, 19 aa, Artificial
  Short Peptide
FKKKLLKIPPKFLHAALKF

SEQ ID NO: 80 - protein, 19 aa, Artificial
  Short Peptide
KWKKLLKIPPKFLHAALKF

SEQ ID NO: 81 - protein, 19 aa, Artificial
  Short Peptide
RWKKLLKIPPKFLHAALKF

SEQ ID NO: 82 - protein, 19 aa, Artificial
  Short Peptide
FWKKLLKIPPKFLHAALKF

SEQ ID NO: 83 - protein, 19 aa, Artificial
  Short Peptide
KKKLFKKIPPKFLHAALKF

SEQ ID NO: 84 - protein, 19 aa, Artificial
  Short Peptide
RKKLFKKIPPKFLHAALKF

SEQ ID NO: 85 - protein, 19 aa, Artificial
  Short Peptide
FKKLFKKIPPKFLHAALKF

SEQ ID NO: 86 - protein, 19 aa, Artificial
  Short Peptide
KWKLFKKIPPKFLHAALKF

SEQ ID NO: 87 - protein, 19 aa, Artificial
  Short Peptide
RWKLFKKIPPKFLHAALKF

SEQ ID NO: 88 - protein, 19 aa, Artificial
  Short Peptide
FWKLFKKIPPKFLHAALKF

SEQ ID NO: 89 - protein, 19 aa, Artificial
  Short Peptide
KKKKFKKIPPKFLHAALKF

SEQ ID NO: 90 - protein, 19 aa, Artificial
  Short Peptide
RKKKFKKIPPKFLHAALKF

SEQ ID NO: 91 - protein, 19 aa, Artificial
  Short Peptide
FKKKFKKIPPKFLHAALKF

SEQ ID NO: 92 - protein, 19 aa, Artificial
  Short Peptide
KWKKFKKIPPKFLHAALKF

SEQ ID NO: 93 - protein, 19 aa, Artificial
  Short Peptide
RWKKFKKIPPKFLHAALKF

SEQ ID NO: 94 - protein, 19 aa, Artificial
  Short Peptide
FWKKFKKIPPKFLHAALKF

SEQ ID NO: 95 - protein, 19 aa, Artificial
  Short Peptide
KKKLLKKIPPKFLHAALKF

SEQ ID NO: 96 - protein, 19 aa, Artificial
  Short Peptide
RKKLLKKIPPKFLHAALKF

SEQ ID NO: 97 - protein, 19 aa, Artificial
  Short Peptide
FKKLLKKIPPKFLHAALKF

SEQ ID NO: 98 - protein, 19 aa, Artificial
  Short Peptide
KWKLLKKIPPKFLHAALKF

SEQ ID NO: 99 - protein, 19 aa, Artificial
  Short Peptide
RWKLLKKIPPKFLHAALKF

SEQ ID NO: 100 - protein, 19 aa, Artificial
  Short Peptide
FWKLLKKIPPKFLHAALKF

SEQ ID NO: 101 - protein, 19 aa, Artificial
  Short Peptide
KKKKLKKIPPKFLHAALKF

SEQ ID NO: 102 - protein, 19 aa, Artificial
  Short Peptide
RKKKLKKIPPKFLHAALKF

SEQ ID NO: 103 - protein, 19 aa, Artificial
  Short Peptide
FKKKLKKIPPKFLHAALKF

SEQ ID NO: 104 - protein, 19 aa, Artificial
  Short Peptide
KWKKLKKIPPKFLHAALKF

SEQ ID NO: 105 - protein, 19 aa, Artificial
  Short Peptide
RWKKLKKIPPKFLHAALKF

SEQ ID NO: 106 - protein, 19 aa, Artificial
  Short Peptide
FWKKLKKIPPKFLHAALKF

SEQ ID NO: 107 - protein, 18 aa, Artificial
  Short Peptide
KKKLFLKIPKFLHAALKF

SEQ ID NO: 108 - protein, 18 aa, Artificial
  Short Peptide
RKKLFLKIPKFLHAALKF

SEQ ID NO: 109 - protein, 18 aa, Artificial
  Short Peptide
FKKLFLKIPKFLHAALKF

SEQ ID NO: 110 - protein, 18 aa, Artificial
  Short Peptide
KWKLFLKIPKFLHAALKF

SEQ ID NO: 111 - protein, 18 aa, Artificial
  Short Peptide
RWKLFLKIPKFLHAALKF

SEQ ID NO: 112 - protein, 18 aa, Artificial
  Short Peptide
FWKLFLKIPKFLHAALKF

SEQ ID NO: 113 - protein, 18 aa, Artificial
  Short Peptide
KKKKFLKIPKFLHAALKF

SEQ ID NO: 114 - protein, 18 aa, Artificial
  Short Peptide
RKKKFLKIPKFLHAALKF

SEQ ID NO: 115 - protein, 18 aa, Artificial
  Short Peptide
FKKKFLKIPKFLHAALKF

SEQ ID NO: 116 - protein, 18 aa, Artificial
  Short Peptide
KWKKFLKIPKFLHAALKF

SEQ ID NO: 117 - protein, 18 aa, Artificial
  Short Peptide
RWKKFLKIPKFLHAALKF

SEQ ID NO: 118 - protein, 18 aa, Artificial
  Short Peptide
FWKKFLKIPKFLHAALKF

SEQ ID NO: 119 - protein, 18 aa, Artificial
  Short Peptide
KKKLLLKIPKFLHAALKF

SEQ ID NO: 120 - protein, 18 aa, Artificial
  Short Peptide
RKKLLLKIPKFLHAALKF

SEQ ID NO: 121 - protein, 18 aa, Artificial
  Short Peptide
FKKLLLKIPKFLHAALKF

SEQ ID NO: 122 - protein, 18 aa, Artificial
  Short Peptide
KWKLLLKIPKFLHAALKF

SEQ ID NO: 123 - protein, 18 aa, Artificial
  Short Peptide
RWKLLLKIPKFLHAALKF

SEQ ID NO: 124 - protein, 18 aa, Artificial
  Short Peptide
FWKLLLKIPKFLHAALKF

SEQ ID NO: 125 - protein, 18 aa, Artificial
  Short Peptide
KKKKLLKIPKFLHAALKF

SEQ ID NO: 126 - protein, 18 aa, Artificial
  Short Peptide
RKKKLLKIPKFLHAALKF

SEQ ID NO: 127 - protein, 18 aa, Artificial
  Short Peptide
FKKKLLKIPKFLHAALKF

SEQ ID NO: 128 - protein, 18 aa, Artificial
  Short Peptide
KWKKLLKIPKFLHAALKF

SEQ ID NO: 129 - protein, 18 aa, Artificial
  Short Peptide
RWKKLLKIPKFLHAALKF

SEQ ID NO: 130 - protein, 18 aa, Artificial
  Short Peptide
FWKKLLKIPKFLHAALKF

SEQ ID NO: 131 - protein, 18 aa, Artificial
  Short Peptide
KKKLFKKIPKFLHAALKF

SEQ ID NO: 132 - protein, 18 aa, Artificial
  Short Peptide
RKKLFKKIPKFLHAALKF

SEQ ID NO: 133 - protein, 18 aa, Artificial
  Short Peptide
FKKLFKKIPKFLHAALKF

SEQ ID NO: 134 - protein, 18 aa, Artificial
  Short Peptide
KWKLFKKIPKFLHAALKF

SEQ ID NO: 135 - protein, 18 aa, Artificial
  Short Peptide
RWKLFKKIPKFLHAALKF

SEQ ID NO: 136 - protein, 18 aa, Artificial
  Short Peptide
FWKLFKKIPKFLHAALKF

SEQ ID NO: 137 - protein, 18 aa, Artificial
  Short Peptide
KKKKFKKIPKFLHAALKF

SEQ ID NO: 138 - protein, 18 aa, Artificial
  Short Peptide
RKKKFKKIPKFLHAALKF

SEQ ID NO: 139 - protein, 18 aa, Artificial
  Short Peptide
FKKKFKKIPKFLHAALKF

SEQ ID NO: 140 - protein, 18 aa, Artificial
  Short Peptide
KWKKFKKIPKFLHAALKF

SEQ ID NO: 141 - protein, 18 aa, Artificial
  Short Peptide
RWKKFKKIPKFLHAALKF

SEQ ID NO: 142 - protein, 18 aa, Artificial
  Short Peptide
FWKKFKKIPKFLHAALKF

SEQ ID NO: 143 - protein, 18 aa, Artificial
  Short Peptide
KKKLLKKIPKFLHAALKF

SEQ ID NO: 144 - protein, 18 aa, Artificial
  Short Peptide
RKKLLKKIPKFLHAALKF

SEQ ID NO: 145 - protein, 18 aa, Artificial
  Short Peptide
FKKLLKKIPKFLHAALKF

SEQ ID NO: 146 - protein, 18 aa, Artificial
  Short Peptide
KWKLLKKIPKFLHAALKF

SEQ ID NO: 147 - protein, 18 aa, Artificial
  Short Peptide
RWKLLKKIPKFLHAALKF

SEQ ID NO: 148 - protein, 18 aa, Artificial
  Short Peptide
FWKLLKKIPKFLHAALKF

SEQ ID NO: 149 - protein, 18 aa, Artificial
  Short Peptide
KKKKLKKIPKFLHAALKF

SEQ ID NO: 150 - protein, 18 aa, Artificial
  Short Peptide
RKKKLKKIPKFLHAALKF

SEQ ID NO: 151 - protein, 18 aa, Artificial
  Short Peptide
FKKKLKKIPKFLHAALKF

SEQ ID NO: 152 - protein, 18 aa, Artificial
  Short Peptide
KWKKLKKIPKFLHAALKF

SEQ ID NO: 153 - protein, 18 aa, Artificial
  Short Peptide
RWKKLKKIPKFLHAALKF

SEQ ID NO: 154 - protein, 18 aa, Artificial
  Short Peptide
FWKKLKKIPKFLHAALKF

SEQ ID NO: 155 - protein, 20 aa, Artificial
  Short Peptide
KKKLFLKIPPPKFKHAALKF

SEQ ID NO: 156 - protein, 20 aa, Artificial
  Short Peptide
RKKLFLKIPPPKFKHAALKF

SEQ ID NO: 157 - protein, 20 aa, Artificial
  Short Peptide
FKKLFLKIPPPKFKHAALKF

SEQ ID NO: 158 - protein, 20 aa, Artificial
  Short Peptide
KWKLFLKIPPPKFKHAALKF

SEQ ID NO: 159 - protein, 20 aa, Artificial
  Short Peptide
RWKLFLKIPPPKFKHAALKF

SEQ ID NO: 160 - protein, 20 aa, Artificial
  Short Peptide
FWKLFLKIPPPKFKHAALKF

SEQ ID NO: 161 - protein, 20 aa, Artificial
  Short Peptide
KKKKFLKIPPPKFKHAALKF

SEQ ID NO: 162 - protein, 20 aa, Artificial
  Short Peptide
RKKKFLKIPPPKFKHAALKF

SEQ ID NO: 163 - protein, 20 aa, Artificial
  Short Peptide
FKKKFLKIPPPKFKHAALKF

SEQ ID NO: 164 - protein, 20 aa, Artificial
  Short Peptide
KWKKFLKIPPPKFKHAALKF

SEQ ID NO: 165 - protein, 20 aa, Artificial
  Short Peptide
RWKKFLKIPPPKFKHAALKF

SEQ ID NO: 166 - protein, 20 aa, Artificial
  Short Peptide
FWKKFLKIPPPKFKHAALKF

SEQ ID NO: 167 - protein, 20 aa, Artificial
  Short Peptide
KKKLLLKIPPPKFKHAALKF

SEQ ID NO: 168 - protein, 20 aa, Artificial
  Short Peptide
RKKLLLKIPPPKFKHAALKF

SEQ ID NO: 169 - protein, 20 aa, Artificial
  Short Peptide
FKKLLLKIPPPKFKHAALKF

SEQ ID NO: 170 - protein, 20 aa, Artificial
  Short Peptide
KWKLLLKIPPPKFKHAALKF

SEQ ID NO: 171 - protein, 20 aa, Artificial
  Short Peptide
RWKLLLKIPPPKFKHAALKF

SEQ ID NO: 172 - protein, 20 aa, Artificial
  Short Peptide
FWKLLLKIPPPKFKHAALKF

SEQ ID NO: 173 - protein, 20 aa, Artificial
  Short Peptide
KKKKLLKIPPPKFKHAALKF

SEQ ID NO: 174 - protein, 20 aa, Artificial
  Short Peptide
RKKKLLKIPPPKFKHAALKF

SEQ ID NO: 175 - protein, 20 aa, Artificial
  Short Peptide
FKKKLLKIPPPKFKHAALKF

SEQ ID NO: 176 - protein, 20 aa, Artificial
  Short Peptide
KWKKLLKIPPPKFKHAALKF

SEQ ID NO: 177 - protein, 20 aa, Artificial
  Short Peptide
RWKKLLKIPPPKFKHAALKF

SEQ ID NO: 178 - protein, 20 aa, Artificial
  Short Peptide
FWKKLLKIPPPKFKHAALKF

SEQ ID NO: 179 - protein, 20 aa, Artificial
  Short Peptide
KKKLFKKIPPPKFKHAALKF

SEQ ID NO: 180 - protein, 20 aa, Artificial
  Short Peptide
RKKLFKKIPPPKFKHAALKF

SEQ ID NO: 181 - protein, 20 aa, Artificial
  Short Peptide
FKKLFKKIPPPKFKHAALKF

SEQ ID NO: 182 - protein, 20 aa, Artificial
  Short Peptide
KWKLFKKIPPPKFKHAALKF

SEQ ID NO: 183 - protein, 20 aa, Artificial
  Short Peptide
RWKLFKKIPPPKFKHAALKF

SEQ ID NO: 184 - protein, 20 aa, Artificial
  Short Peptide
FWKLFKKIPPPKFKHAALKF

SEQ ID NO: 185 - protein, 20 aa, Artificial
  Short Peptide
KKKKFKKIPPPKFKHAALKF

SEQ ID NO: 186 - protein, 20 aa, Artificial
  Short Peptide
RKKKFKKIPPPKFKHAALKF

SEQ ID NO: 187 - protein, 20 aa, Artificial
  Short Peptide
FKKKFKKIPPPKFKHAALKF

SEQ ID NO: 188 - protein, 20 aa, Artificial
  Short Peptide
KWKKFKKIPPPKFKHAALKF

SEQ ID NO: 189 - protein, 20 aa, Artificial
  Short Peptide
RWKKFKKIPPPKFKHAALKF

SEQ ID NO: 190 - protein, 20 aa, Artificial
  Short Peptide
FWKKFKKIPPPKFKHAALKF

SEQ ID NO: 191 - protein, 20 aa, Artificial
  Short Peptide
KKKLLKKIPPPKFKHAALKF

SEQ ID NO: 192 - protein, 20 aa, Artificial
  Short Peptide
RKKLLKKIPPPKFKHAALKF

SEQ ID NO: 193 - protein, 20 aa, Artificial
  Short Peptide
FKKLLKKIPPPKFKHAALKF

SEQ ID NO: 194 - protein, 20 aa, Artificial
  Short Peptide
KWKLLKKIPPPKFKHAALKF

SEQ ID NO: 195 - protein, 20 aa, Artificial
  Short Peptide
RWKLLKKIPPPKFKHAALKF

SEQ ID NO: 196 - protein, 20 aa, Artificial
  Short Peptide
FWKLLKKIPPPKFKHAALKF

SEQ ID NO: 197 - protein, 20 aa, Artificial
  Short Peptide
KKKKLKKIPPPKFKHAALKF

SEQ ID NO: 198 - protein, 20 aa, Artificial
  Short Peptide
RKKKLKKIPPPKFKHAALKF

SEQ ID NO: 199 - protein, 20 aa, Artificial
  Short Peptide
FKKKLKKIPPPKFKHAALKF

SEQ ID NO: 200 - protein, 20 aa, Artificial
  Short Peptide
KWKKLKKIPPPKFKHAALKF

SEQ ID NO: 201 - protein, 20 aa, Artificial
  Short Peptide
RWKKLKKIPPPKFKHAALKF

SEQ ID NO: 202 - protein, 20 aa, Artificial
  Short Peptide
FWKKLKKIPPPKFKHAALKF

SEQ ID NO: 203 - protein, 19 aa, Artificial
  Short Peptide
KKKLFLKIPPKFKHAALKF

SEQ ID NO: 204 - protein, 19 aa, Artificial
  Short Peptide
RKKLFLKIPPKFKHAALKF

SEQ ID NO: 205 - protein, 19 aa, Artificial
  Short Peptide
FKKLFLKIPPKFKHAALKF

SEQ ID NO: 206 - protein, 19 aa, Artificial
  Short Peptide
KWKLFLKIPPKFKHAALKF

SEQ ID NO: 207 - protein, 19 aa, Artificial
  Short Peptide
RWKLFLKIPPKFKHAALKF

SEQ ID NO: 208 - protein, 19 aa, Artificial
  Short Peptide
FWKLFLKIPPKFKHAALKF

SEQ ID NO: 209 - protein, 19 aa, Artificial
  Short Peptide
KKKKFLKIPPKFKHAALKF

SEQ ID NO: 210 - protein, 19 aa, Artificial
  Short Peptide
RKKKFLKIPPKFKHAALKF

SEQ ID NO: 211 - protein, 19 aa, Artificial
  Short Peptide
FKKKFLKIPPKFKHAALKF

SEQ ID NO: 212 - protein, 19 aa, Artificial
  Short Peptide
KWKKFLKIPPKFKHAALKF

SEQ ID NO: 213 - protein, 19 aa, Artificial
  Short Peptide
RWKKFLKIPPKFKHAALKF

SEQ ID NO: 214 - protein, 19 aa, Artificial
  Short Peptide
FWKKFLKIPPKFKHAALKF

SEQ ID NO: 215 - protein, 19 aa, Artificial
  Short Peptide
KKKLLLKIPPKFKHAALKF

SEQ ID NO: 216 - protein, 19 aa, Artificial
  Short Peptide
RKKLLLKIPPKFKHAALKF

SEQ ID NO: 217 - protein, 19 aa, Artificial
  Short Peptide
FKKLLLKIPPKFKHAALKF

SEQ ID NO: 218 - protein, 19 aa, Artificial
  Short Peptide
KWKLLLKIPPKFKHAALKF

SEQ ID NO: 219 - protein, 19 aa, Artificial
  Short Peptide
RWKLLLKIPPKFKHAALKF

SEQ ID NO: 220 - protein, 19 aa, Artificial
  Short Peptide
FWKLLLKIPPKFKHAALKF

SEQ ID NO: 221 - protein, 19 aa, Artificial
  Short Peptide
KKKKLLKIPPKFKHAALKF

SEQ ID NO: 222 - protein, 19 aa, Artificial
  Short Peptide
RKKKLLKIPPKFKHAALKF

SEQ ID NO: 223 - protein, 19 aa, Artificial
  Short Peptide
FKKKLLKIPPKFKHAALKF

SEQ ID NO: 224 - protein, 19 aa, Artificial
  Short Peptide
KWKKLLKIPPKFKHAALKF

SEQ ID NO: 225 - protein, 19 aa, Artificial
  Short Peptide
RWKKLLKIPPKFKHAALKF

SEQ ID NO: 226 - protein, 19 aa, Artificial
  Short Peptide
FWKKLLKIPPKFKHAALKF

SEQ ID NO: 227 - protein, 19 aa, Artificial
  Short Peptide
KKKLFKKIPPKFKHAALKF

SEQ ID NO: 228 - protein, 19 aa, Artificial
  Short Peptide
RKKLFKKIPPKFKHAALKF

SEQ ID NO: 229 - protein, 19 aa, Artificial
  Short Peptide
FKKLFKKIPPKFKHAALKF

SEQ ID NO: 230 - protein, 19 aa, Artificial
  Short Peptide
KWKLFKKIPPKFKHAALKF

SEQ ID NO: 231 - protein, 19 aa, Artificial
  Short Peptide
RWKLFKKIPPKFKHAALKF

SEQ ID NO: 232 - protein, 19 aa, Artificial
  Short Peptide
FWKLFKKIPPKFKHAALKF

SEQ ID NO: 233 - protein, 19 aa, Artificial
  Short Peptide
KKKKFKKIPPKFKHAALKF

SEQ ID NO: 234 - protein, 19 aa, Artificial
  Short Peptide
RKKKFKKIPPKFKHAALKF

SEQ ID NO: 235 - protein, 19 aa, Artificial
  Short Peptide
FKKKFKKIPPKFKHAALKF

SEQ ID NO: 236 - protein, 19 aa, Artificial
  Short Peptide
KWKKFKKIPPKFKHAALKF

SEQ ID NO: 237 - protein, 19 aa, Artificial
  Short Peptide
RWKKFKKIPPKFKHAALKF

SEQ ID NO: 238 - protein, 19 aa, Artificial
  Short Peptide
FWKKFKKIPPKFKHAALKF

SEQ ID NO: 239 - protein, 19 aa, Artificial
  Short Peptide
KKKLLKKIPPKFKHAALKF

SEQ ID NO: 240 - protein, 19 aa, Artificial
  Short Peptide
RKKLLKKIPPKFKHAALKF

SEQ ID NO: 241 - protein, 19 aa, Artificial
  Short Peptide
FKKLLKKIPPKFKHAALKF

SEQ ID NO: 242 - protein, 19 aa, Artificial
  Short Peptide
KWKLLKKIPPKFKHAALKF

SEQ ID NO: 243 - protein, 19 aa, Artificial
  Short Peptide
RWKLLKKIPPKFKHAALKF

SEQ ID NO: 244 - protein, 19 aa, Artificial
  Short Peptide
FWKLLKKIPPKFKHAALKF

SEQ ID NO: 245 - protein, 19 aa, Artificial
  Short Peptide
KKKKLKKIPPKFKHAALKF

SEQ ID NO: 246 - protein, 19 aa, Artificial
  Short Peptide
RKKKLKKIPPKFKHAALKF

SEQ ID NO: 247 - protein, 19 aa, Artificial
  Short Peptide
FKKKLKKIPPKFKHAALKF

SEQ ID NO: 248 - protein, 19 aa, Artificial
  Short Peptide
KWKKLKKIPPKFKHAALKF

SEQ ID NO: 249 - protein, 19 aa, Artificial
  Short Peptide
RWKKLKKIPPKFKHAALKF

SEQ ID NO: 250 - protein, 19 aa, Artificial
  Short Peptide
FWKKLKKIPPKFKHAALKF

SEQ ID NO: 251 - protein, 18 aa, Artificial
  Short Peptide
KKKLFLKIPKFKHAALKF

SEQ ID NO: 252 - protein, 18 aa, Artificial
  Short Peptide
RKKLFLKIPKFKHAALKF

SEQ ID NO: 253 - protein, 18 aa, Artificial
  Short Peptide
FKKLFLKIPKFKHAALKF

SEQ ID NO: 254 - protein, 18 aa, Artificial
  Short Peptide
KWKLFLKIPKFKHAALKF

SEQ ID NO: 255 - protein, 18 aa, Artificial
  Short Peptide
RWKLFLKIPKFKHAALKF

SEQ ID NO: 256 - protein, 18 aa, Artificial
  Short Peptide
FWKLFLKIPKFKHAALKF

SEQ ID NO: 257 - protein, 18 aa, Artificial
  Short Peptide
KKKKFLKIPKFKHAALKF

SEQ ID NO: 258 - protein, 18 aa, Artificial
  Short Peptide
RKKKFLKIPKFKHAALKF

SEQ ID NO: 259 - protein, 18 aa, Artificial
  Short Peptide
FKKKFLKIPKFKHAALKF

SEQ ID NO: 260 - protein, 18 aa, Artificial
  Short Peptide
KWKKFLKIPKFKHAALKF

SEQ ID NO: 261 - protein, 18 aa, Artificial
  Short Peptide
RWKKFLKIPKFKHAALKF

SEQ ID NO: 262 - protein, 18 aa, Artificial
  Short Peptide
FWKKFLKIPKFKHAALKF

SEQ ID NO: 263 - protein, 18 aa, Artificial
  Short Peptide
KKKLLLKIPKFKHAALKF

SEQ ID NO: 264 - protein, 18 aa, Artificial
  Short Peptide
RKKLLLKIPKFKHAALKF

SEQ ID NO: 265 - protein, 18 aa, Artificial
  Short Peptide
FKKLLLKIPKFKHAALKF

SEQ ID NO: 266 - protein, 18 aa, Artificial
  Short Peptide
KWKLLLKIPKFKHAALKF

SEQ ID NO: 267 - protein, 18 aa, Artificial
  Short Peptide
RWKLLLKIPKFKHAALKF

SEQ ID NO: 268 - protein, 18 aa, Artificial
  Short Peptide
FWKLLLKIPKFKHAALKF

SEQ ID NO: 269 - protein, 18 aa, Artificial
  Short Peptide
KKKKLLKIPKFKHAALKF

SEQ ID NO: 270 - protein, 18 aa, Artificial
  Short Peptide
RKKKLLKIPKFKHAALKF

SEQ ID NO: 271 - protein, 18 aa, Artificial
  Short Peptide
FKKKLLKIPKFKHAALKF

SEQ ID NO: 272 - protein, 18 aa, Artificial
  Short Peptide
KWKKLLKIPKFKHAALKF

SEQ ID NO: 273 - protein, 18 aa, Artificial
  Short Peptide
RWKKLLKIPKFKHAALKF

SEQ ID NO: 274 - protein, 18 aa, Artificial
  Short Peptide
FWKKLLKIPKFKHAALKF

SEQ ID NO: 275 - protein, 18 aa, Artificial
  Short Peptide
KKKLFKKIPKFKHAALKF

SEQ ID NO: 276 - protein, 18 aa, Artificial
  Short Peptide
RKKLFKKIPKFKHAALKF

SEQ ID NO: 277 - protein, 18 aa, Artificial
  Short Peptide
FKKLFKKIPKFKHAALKF

SEQ ID NO: 278 - protein, 18 aa, Artificial
  Short Peptide
KWKLFKKIPKFKHAALKF

SEQ ID NO: 279 - protein, 18 aa, Artificial
  Short Peptide
RWKLFKKIPKFKHAALKF

SEQ ID NO: 280 - protein, 18 aa, Artificial
  Short Peptide
FWKLFKKIPKFKHAALKF

SEQ ID NO: 281 - protein, 18 aa, Artificial
  Short Peptide
KKKKFKKIPKFKHAALKF

SEQ ID NO: 282 - protein, 18 aa, Artificial
  Short Peptide
RKKKFKKIPKFKHAALKF

SEQ ID NO: 283 - protein, 18 aa, Artificial
  Short Peptide
FKKKFKKIPKFKHAALKF

SEQ ID NO: 284 - protein, 18 aa, Artificial
  Short Peptide
KWKKFKKIPKFKHAALKF

SEQ ID NO: 285 - protein, 18 aa, Artificial
  Short Peptide
RWKKFKKIPKFKHAALKF

SEQ ID NO: 286 - protein, 18 aa, Artificial
  Short Peptide
FWKKFKKIPKFKHAALKF

SEQ ID NO: 287 - protein, 18 aa, Artificial
  Short Peptide
KKKLLKKIPKFKHAALKF

SEQ ID NO: 288 - protein, 18 aa, Artificial
  Short Peptide
RKKLLKKIPKFKHAALKF

SEQ ID NO: 289 - protein, 18 aa, Artificial
  Short Peptide
FKKLLKKIPKFKHAALKF

SEQ ID NO: 290 - protein, 18 aa, Artificial
  Short Peptide
KWKLLKKIPKFKHAALKF

SEQ ID NO: 291 - protein, 18 aa, Artificial
  Short Peptide
RWKLLKKIPKFKHAALKF

SEQ ID NO: 292 - protein, 18 aa, Artificial
  Short Peptide
FWKLLKKIPKFKHAALKF

SEQ ID NO: 293 - protein, 18 aa, Artificial
  Short Peptide
KKKKLKKIPKFKHAALKF

SEQ ID NO: 294 - protein, 18 aa, Artificial
  Short Peptide
RKKKLKKIPKFKHAALKF

SEQ ID NO: 295 - protein, 18 aa, Artificial
  Short Peptide
FKKKLKKIPKFKHAALKF

SEQ ID NO: 296 - protein, 18 aa, Artificial
  Short Peptide
KWKKLKKIPKFKHAALKF

SEQ ID NO: 297 - protein, 18 aa, Artificial
  Short Peptide
RWKKLKKIPKFKHAALKF

SEQ ID NO: 298 - protein, 18 aa, Artificial
  Short Peptide
FWKKLKKIPKFKHAALKF

SEQ ID NO: 299 - protein, 20 aa, Artificial
  Short Peptide
KKKLFLKIPPPKFLKAALKF

SEQ ID NO: 300 - protein, 20 aa, Artificial
  Short Peptide
RKKLFLKIPPPKFLKAALKF

SEQ ID NO: 301 - protein, 20 aa, Artificial
  Short Peptide
FKKLFLKIPPPKFLKAALKF

SEQ ID NO: 302 - protein, 20 aa, Artificial
  Short Peptide
KWKLFLKIPPPKFLKAALKF

SEQ ID NO: 303 - protein, 20 aa, Artificial
  Short Peptide
RWKLFLKIPPPKFLKAALKF

SEQ ID NO: 304 - protein, 20 aa, Artificial
  Short Peptide
FWKLFLKIPPPKFLKAALKF

SEQ ID NO: 305 - protein, 20 aa, Artificial
  Short Peptide
KKKKFLKIPPPKFLKAALKF

SEQ ID NO: 306 - protein, 20 aa, Artificial
  Short Peptide
RKKKFLKIPPPKFLKAALKF

SEQ ID NO: 307 - protein, 20 aa, Artificial
  Short Peptide
FKKKFLKIPPPKFLKAALKF

SEQ ID NO: 308 - protein, 20 aa, Artificial
  Short Peptide
KWKKFLKIPPPKFLKAALKF

SEQ ID NO: 309 - protein, 20 aa, Artificial
  Short Peptide
RWKKFLKIPPPKFLKAALKF

SEQ ID NO: 310 - protein, 20 aa, Artificial
  Short Peptide
FWKKFLKIPPPKFLKAALKF

SEQ ID NO: 311 - protein, 20 aa, Artificial
  Short Peptide
KKKLLLKIPPPKFLKAALKF

SEQ ID NO: 312 - protein, 20 aa, Artificial
  Short Peptide
RKKLLLKIPPPKFLKAALKF

SEQ ID NO: 313 - protein, 20 aa, Artificial
  Short Peptide
FKKLLLKIPPPKFLKAALKF

SEQ ID NO: 314 - protein, 20 aa, Artificial
  Short Peptide
KWKLLLKIPPPKFLKAALKF

SEQ ID NO: 315 - protein, 20 aa, Artificial
  Short Peptide
RWKLLLKIPPPKFLKAALKF

SEQ ID NO: 316 - protein, 20 aa, Artificial
  Short Peptide
FWKLLLKIPPPKFLKAALKF

SEQ ID NO: 317 - protein, 20 aa, Artificial
  Short Peptide
KKKKLLKIPPPKFLKAALKF

SEQ ID NO: 318 - protein, 20 aa, Artificial
  Short Peptide
RKKKLLKIPPPKFLKAALKF

SEQ ID NO: 319 - protein, 20 aa, Artificial
  Short Peptide
FKKKLLKIPPPKFLKAALKF

SEQ ID NO: 320 - protein, 20 aa, Artificial
  Short Peptide
KWKKLLKIPPPKFLKAALKF

SEQ ID NO: 321 - protein, 20 aa, Artificial
  Short Peptide
RWKKLLKIPPPKFLKAALKF

SEQ ID NO: 322 - protein, 20 aa, Artificial
  Short Peptide
FWKKLLKIPPPKFLKAALKF

SEQ ID NO: 323 - protein, 20 aa, Artificial
  Short Peptide
KKKLFKKIPPPKFLKAALKF

SEQ ID NO: 324 - protein, 20 aa, Artificial
  Short Peptide
RKKLFKKIPPPKFLKAALKF

SEQ ID NO: 325 - protein, 20 aa, Artificial
  Short Peptide
FKKLFKKIPPPKFLKAALKF

SEQ ID NO: 326 - protein, 20 aa, Artificial
  Short Peptide
KWKLFKKIPPPKFLKAALKF

SEQ ID NO: 327 - protein, 20 aa, Artificial
  Short Peptide
RWKLFKKIPPPKFLKAALKF

SEQ ID NO: 328 - protein, 20 aa, Artificial
  Short Peptide
FWKLFKKIPPPKFLKAALKF

SEQ ID NO: 329 - protein, 20 aa, Artificial
  Short Peptide
KKKKFKKIPPPKFLKAALKF

SEQ ID NO: 330 - protein, 20 aa, Artificial
  Short Peptide
RKKKFKKIPPPKFLKAALKF

SEQ ID NO: 331 - protein, 20 aa, Artificial
  Short Peptide
FKKKFKKIPPPKFLKAALKF

SEQ ID NO: 332 - protein, 20 aa, Artificial
  Short Peptide
KWKKFKKIPPPKFLKAALKF

SEQ ID NO: 333 - protein, 20 aa, Artificial
  Short Peptide
RWKKFKKIPPPKFLKAALKF

SEQ ID NO: 334 - protein, 20 aa, Artificial
  Short Peptide
FWKKFKKIPPPKFLKAALKF

SEQ ID NO: 335 - protein, 20 aa, Artificial
  Short Peptide
KKKLLKKIPPPKFLKAALKF

SEQ ID NO: 336 - protein, 20 aa, Artificial
  Short Peptide
RKKLLKKIPPPKFLKAALKF

SEQ ID NO: 337 - protein, 20 aa, Artificial
  Short Peptide
FKKLLKKIPPPKFLKAALKF

SEQ ID NO: 338 - protein, 20 aa, Artificial
  Short Peptide
KWKLLKKIPPPKFLKAALKF

SEQ ID NO: 339 - protein, 20 aa, Artificial
  Short Peptide
RWKLLKKIPPPKFLKAALKF

SEQ ID NO: 340 - protein, 20 aa, Artificial
  Short Peptide
FWKLLKKIPPPKFLKAALKF

SEQ ID NO: 341 - protein, 20 aa, Artificial
  Short Peptide
KKKKLKKIPPPKFLKAALKF

SEQ ID NO: 342 - protein, 20 aa, Artificial
  Short Peptide
RKKKLKKIPPPKFLKAALKF

SEQ ID NO: 343 - protein, 20 aa, Artificial
  Short Peptide
FKKKLKKIPPPKFLKAALKF

SEQ ID NO: 344 - protein, 20 aa, Artificial
  Short Peptide
KWKKLKKIPPPKFLKAALKF

SEQ ID NO: 345 - protein, 20 aa, Artificial
  Short Peptide
RWKKLKKIPPPKFLKAALKF

SEQ ID NO: 346 - protein, 20 aa, Artificial
  Short Peptide
FWKKLKKIPPPKFLKAALKF

SEQ ID NO: 347 - protein, 19 aa, Artificial
  Short Peptide
KKKLFLKIPPKFLKAALKF

SEQ ID NO: 348 - protein, 19 aa, Artificial
  Short Peptide
RKKLFLKIPPKFLKAALKF

SEQ ID NO: 349 - protein, 19 aa, Artificial
  Short Peptide
FKKLFLKIPPKFLKAALKF

SEQ ID NO: 350 - protein, 19 aa, Artificial
  Short Peptide
KWKLFLKIPPKFLKAALKF

SEQ ID NO: 351 - protein, 19 aa, Artificial
  Short Peptide
RWKLFLKIPPKFLKAALKF

SEQ ID NO: 352 - protein, 19 aa, Artificial
  Short Peptide
FWKLFLKIPPKFLKAALKF

SEQ ID NO: 353 - protein, 19 aa, Artificial
  Short Peptide
KKKKFLKIPPKFLKAALKF

SEQ ID NO: 354 - protein, 19 aa, Artificial
  Short Peptide
RKKKFLKIPPKFLKAALKF

SEQ ID NO: 355 - protein, 19 aa, Artificial
  Short Peptide
FKKKFLKIPPKFLKAALKF

SEQ ID NO: 356 - protein, 19 aa, Artificial
  Short Peptide
KWKKFLKIPPKFLKAALKF

SEQ ID NO: 357 - protein, 19 aa, Artificial
  Short Peptide
RWKKFLKIPPKFLKAALKF

SEQ ID NO: 358 - protein, 19 aa, Artificial
  Short Peptide
FWKKFLKIPPKFLKAALKF

SEQ ID NO: 359 - protein, 19 aa, Artificial
  Short Peptide
KKKLLLKIPPKFLKAALKF

SEQ ID NO: 360 - protein, 19 aa, Artificial
  Short Peptide
RKKLLLKIPPKFLKAALKF

SEQ ID NO: 361 - protein, 19 aa, Artificial
  Short Peptide
FKKLLLKIPPKFLKAALKF

SEQ ID NO: 362 - protein, 19 aa, Artificial
  Short Peptide
KWKLLLKIPPKFLKAALKF

SEQ ID NO: 363 - protein, 19 aa, Artificial
  Short Peptide
RWKLLLKIPPKFLKAALKF

SEQ ID NO: 364 - protein, 19 aa, Artificial
  Short Peptide
FWKLLLKIPPKFLKAALKF

SEQ ID NO: 365 - protein, 19 aa, Artificial
  Short Peptide
KKKKLLKIPPKFLKAALKF

SEQ ID NO: 366 - protein, 19 aa, Artificial
  Short Peptide
RKKKLLKIPPKFLKAALKF

SEQ ID NO: 367 - protein, 19 aa, Artificial
  Short Peptide
FKKKLLKIPPKFLKAALKF

SEQ ID NO: 368 - protein, 19 aa, Artificial
  Short Peptide
KWKKLLKIPPKFLKAALKF

SEQ ID NO: 369 - protein, 19 aa, Artificial
  Short Peptide
RWKKLLKIPPKFLKAALKF

SEQ ID NO: 370 - protein, 19 aa, Artificial
  Short Peptide
FWKKLLKIPPKFLKAALKF

SEQ ID NO: 371 - protein, 19 aa, Artificial
  Short Peptide
KKKLFKKIPPKFLKAALKF

SEQ ID NO: 372 - protein, 19 aa, Artificial
  Short Peptide
RKKLFKKIPPKFLKAALKF

SEQ ID NO: 373 - protein, 19 aa, Artificial
  Short Peptide
FKKLFKKIPPKFLKAALKF

SEQ ID NO: 374 - protein, 19 aa, Artificial
  Short Peptide
KWKLFKKIPPKFLKAALKF

SEQ ID NO: 375 - protein, 19 aa, Artificial
  Short Peptide
RWKLFKKIPPKFLKAALKF

SEQ ID NO: 376 - protein, 19 aa, Artificial
  Short Peptide
FWKLFKKIPPKFLKAALKF

SEQ ID NO: 377 - protein, 19 aa, Artificial
  Short Peptide
KKKKFKKIPPKFLKAALKF

SEQ ID NO: 378 - protein, 19 aa, Artificial
  Short Peptide
RKKKFKKIPPKFLKAALKF

SEQ ID NO: 379 - protein, 19 aa, Artificial
  Short Peptide
FKKKFKKIPPKFLKAALKF

SEQ ID NO: 380 - protein, 19 aa, Artificial
  Short Peptide
KWKKFKKIPPKFLKAALKF

SEQ ID NO: 381 - protein, 19 aa, Artificial
  Short Peptide
RWKKFKKIPPKFLKAALKF

SEQ ID NO: 382 - protein, 19 aa, Artificial
  Short Peptide
FWKKFKKIPPKFLKAALKF

SEQ ID NO: 383 - protein, 19 aa, Artificial
  Short Peptide
KKKLLKKIPPKFLKAALKF

SEQ ID NO: 384 - protein, 19 aa, Artificial
  Short Peptide
RKKLLKKIPPKFLKAALKF

SEQ ID NO: 385 - protein, 19 aa, Artificial
  Short Peptide
FKKLLKKIPPKFLKAALKF

SEQ ID NO: 386 - protein, 19 aa, Artificial
  Short Peptide
KWKLLKKIPPKFLKAALKF

SEQ ID NO: 387 - protein, 19 aa, Artificial
  Short Peptide
RWKLLKKIPPKFLKAALKF

SEQ ID NO: 388 - protein, 19 aa, Artificial
  Short Peptide
FWKLLKKIPPKFLKAALKF

SEQ ID NO: 389 - protein, 19 aa, Artificial
  Short Peptide
KKKKLKKIPPKFLKAALKF

SEQ ID NO: 390 - protein, 19 aa, Artificial
  Short Peptide
RKKKLKKIPPKFLKAALKF

SEQ ID NO: 391 - protein, 19 aa, Artificial
  Short Peptide
FKKKLKKIPPKFLKAALKF

SEQ ID NO: 392 - protein, 19 aa, Artificial
  Short Peptide
KWKKLKKIPPKFLKAALKF

SEQ ID NO: 393 - protein, 19 aa, Artificial
  Short Peptide
RWKKLKKIPPKFLKAALKF

SEQ ID NO: 394 - protein, 19 aa, Artificial
  Short Peptide
FWKKLKKIPPKFLKAALKF

SEQ ID NO: 395 - protein, 18 aa, Artificial
  Short Peptide
KKKLFLKIPKFLKAALKF

SEQ ID NO: 396 - protein, 18 aa, Artificial
  Short Peptide
RKKLFLKIPKFLKAALKF

SEQ ID NO: 397 - protein, 18 aa, Artificial
  Short Peptide
FKKLFLKIPKFLKAALKF

SEQ ID NO: 398 - protein, 18 aa, Artificial
  Short Peptide
KWKLFLKIPKFLKAALKF

SEQ ID NO: 399 - protein, 18 aa, Artificial
  Short Peptide
RWKLFLKIPKFLKAALKF

SEQ ID NO: 400 - protein, 18 aa, Artificial
  Short Peptide
FWKLFLKIPKFLKAALKF

SEQ ID NO: 401 - protein, 18 aa, Artificial
  Short Peptide
KKKKFLKIPKFLKAALKF

SEQ ID NO: 402 - protein, 18 aa, Artificial
  Short Peptide
RKKKFLKIPKFLKAALKF

SEQ ID NO: 403 - protein, 18 aa, Artificial
  Short Peptide
FKKKFLKIPKFLKAALKF

SEQ ID NO: 404 - protein, 18 aa, Artificial
  Short Peptide
KWKKFLKIPKFLKAALKF

SEQ ID NO: 405 - protein, 18 aa, Artificial
  Short Peptide
RWKKFLKIPKFLKAALKF

SEQ ID NO: 406 - protein, 18 aa, Artificial
  Short Peptide
FWKKFLKIPKFLKAALKF

SEQ ID NO: 407 - protein, 18 aa, Artificial
  Short Peptide
KKKLLLKIPKFLKAALKF

SEQ ID NO: 408 - protein, 18 aa, Artificial
  Short Peptide
RKKLLLKIPKFLKAALKF

SEQ ID NO: 409 - protein, 18 aa, Artificial
  Short Peptide
FKKLLLKIPKFLKAALKF

SEQ ID NO: 410 - protein, 18 aa, Artificial
  Short Peptide
KWKLLLKIPKFLKAALKF

SEQ ID NO: 411 - protein, 18 aa, Artificial
  Short Peptide
RWKLLLKIPKFLKAALKF

SEQ ID NO: 412 - protein, 18 aa, Artificial
  Short Peptide
FWKLLLKIPKFLKAALKF

SEQ ID NO: 413 - protein, 18 aa, Artificial
  Short Peptide
KKKKLLKIPKFLKAALKF

SEQ ID NO: 414 - protein, 18 aa, Artificial
  Short Peptide
RKKKLLKIPKFLKAALKF

SEQ ID NO: 415 - protein, 18 aa, Artificial
  Short Peptide
FKKKLLKIPKFLKAALKF

SEQ ID NO: 416 - protein, 18 aa, Artificial
  Short Peptide
KWKKLLKIPKFLKAALKF

SEQ ID NO: 417 - protein, 18 aa, Artificial
  Short Peptide
RWKKLLKIPKFLKAALKF

SEQ ID NO: 418 - protein, 18 aa, Artificial
  Short Peptide
FWKKLLKIPKFLKAALKF

SEQ ID NO: 419 - protein, 18 aa, Artificial
  Short Peptide
KKKLFKKIPKFLKAALKF

SEQ ID NO: 420 - protein, 18 aa, Artificial
  Short Peptide
RKKLFKKIPKFLKAALKF

SEQ ID NO: 421 - protein, 18 aa, Artificial
  Short Peptide
FKKLFKKIPKFLKAALKF

SEQ ID NO: 422 - protein, 18 aa, Artificial
  Short Peptide
KWKLFKKIPKFLKAALKF

SEQ ID NO: 423 - protein, 18 aa, Artificial
  Short Peptide
RWKLFKKIPKFLKAALKF

SEQ ID NO: 424 - protein, 18 aa, Artificial
  Short Peptide
FWKLFKKIPKFLKAALKF

SEQ ID NO: 425 - protein, 18 aa, Artificial
  Short Peptide
KKKKFKKIPKFLKAALKF

SEQ ID NO: 426 - protein, 18 aa, Artificial
  Short Peptide
RKKKFKKIPKFLKAALKF

SEQ ID NO: 427 - protein, 18 aa, Artificial
  Short Peptide
FKKKFKKIPKFLKAALKF

SEQ ID NO: 428 - protein, 18 aa, Artificial
  Short Peptide
KWKKFKKIPKFLKAALKF

SEQ ID NO: 429 - protein, 18 aa, Artificial
  Short Peptide
RWKKFKKIPKFLKAALKF

SEQ ID NO: 430 - protein, 18 aa, Artificial
  Short Peptide
FWKKFKKIPKFLKAALKF

SEQ ID NO: 431 - protein, 18 aa, Artificial
  Short Peptide
KKKLLKKIPKFLKAALKF

SEQ ID NO: 432 - protein, 18 aa, Artificial
  Short Peptide
RKKLLKKIPKFLKAALKF

SEQ ID NO: 433 - protein, 18 aa, Artificial
  Short Peptide
FKKLLKKIPKFLKAALKF

SEQ ID NO: 434 - protein, 18 aa, Artificial
  Short Peptide
KWKLLKKIPKFLKAALKF

SEQ ID NO: 435 - protein, 18 aa, Artificial
  Short Peptide
RWKLLKKIPKFLKAALKF

SEQ ID NO: 436 - protein, 18 aa, Artificial
  Short Peptide
FWKLLKKIPKFLKAALKF

SEQ ID NO: 437 - protein, 18 aa, Artificial
  Short Peptide
KKKKLKKIPKFLKAALKF

SEQ ID NO: 438 - protein, 18 aa, Artificial
  Short Peptide
RKKKLKKIPKFLKAALKF

SEQ ID NO: 439 - protein, 18 aa, Artificial
  Short Peptide
FKKKLKKIPKFLKAALKF

SEQ ID NO: 440 - protein, 18 aa, Artificial
  Short Peptide
KWKKLKKIPKFLKAALKF

SEQ ID NO: 441 - protein, 18 aa, Artificial
  Short Peptide
RWKKLKKIPKFLKAALKF

SEQ ID NO: 442 - protein, 18 aa, Artificial
  Short Peptide
FWKKLKKIPKFLKAALKF

SEQ ID NO: 443 - protein, 20 aa, Artificial
  Short Peptide
KKKLFLKIPPPKFKKAALKF

SEQ ID NO: 444 - protein, 20 aa, Artificial
  Short Peptide
RKKLFLKIPPPKFKKAALKF

SEQ ID NO: 445 - protein, 20 aa, Artificial
  Short Peptide
FKKLFLKIPPPKFKKAALKF

SEQ ID NO: 446 - protein, 20 aa, Artificial
  Short Peptide
KWKLFLKIPPPKFKKAALKF

SEQ ID NO: 447 - protein, 20 aa, Artificial
  Short Peptide
RWKLFLKIPPPKFKKAALKF

SEQ ID NO: 448 - protein, 20 aa, Artificial
  Short Peptide
FWKLFLKIPPPKFKKAALKF

SEQ ID NO: 449 - protein, 20 aa, Artificial
  Short Peptide
KKKKFLKIPPPKFKKAALKF

SEQ ID NO: 450 - protein, 20 aa, Artificial
  Short Peptide
RKKKFLKIPPPKFKKAALKF

SEQ ID NO: 451 - protein, 20 aa, Artificial
  Short Peptide
FKKKFLKIPPPKFKKAALKF

SEQ ID NO: 452 - protein, 20 aa, Artificial
  Short Peptide
KWKKFLKIPPPKFKKAALKF

SEQ ID NO: 453 - protein, 20 aa, Artificial
  Short Peptide
RWKKFLKIPPPKFKKAALKF

SEQ ID NO: 454 - protein, 20 aa, Artificial
  Short Peptide
FWKKFLKIPPPKFKKAALKF

SEQ ID NO: 455 - protein, 20 aa, Artificial
  Short Peptide
KKKLLLKIPPPKFKKAALKF

SEQ ID NO: 456 - protein, 20 aa, Artificial
  Short Peptide
RKKLLLKIPPPKFKKAALKF

SEQ ID NO: 457 - protein, 20 aa, Artificial
  Short Peptide
FKKLLLKIPPPKFKKAALKF

SEQ ID NO: 458 - protein, 20 aa, Artificial
  Short Peptide
KWKLLLKIPPPKFKKAALKF

SEQ ID NO: 459 - protein, 20 aa, Artificial
  Short Peptide
RWKLLLKIPPPKFKKAALKF

SEQ ID NO: 460 - protein, 20 aa, Artificial
  Short Peptide
FWKLLLKIPPPKFKKAALKF

SEQ ID NO: 461 - protein, 20 aa, Artificial
  Short Peptide
KKKKLLKIPPPKFKKAALKF

SEQ ID NO: 462 - protein, 20 aa, Artificial
  Short Peptide
RKKKLLKIPPPKFKKAALKF

SEQ ID NO: 463 - protein, 20 aa, Artificial
  Short Peptide
FKKKLLKIPPPKFKKAALKF

SEQ ID NO: 464 - protein, 20 aa, Artificial
  Short Peptide
KWKKLLKIPPPKFKKAALKF

SEQ ID NO: 465 - protein, 20 aa, Artificial
  Short Peptide
RWKKLLKIPPPKFKKAALKF

SEQ ID NO: 466 - protein, 20 aa, Artificial
  Short Peptide
FWKKLLKIPPPKFKKAALKF

SEQ ID NO: 467 - protein, 20 aa, Artificial
  Short Peptide
KKKLFKKIPPPKFKKAALKF

SEQ ID NO: 468 - protein, 20 aa, Artificial
  Short Peptide
RKKLFKKIPPPKFKKAALKF

SEQ ID NO: 469 - protein, 20 aa, Artificial
  Short Peptide
FKKLFKKIPPPKFKKAALKF

SEQ ID NO: 470 - protein, 20 aa, Artificial
  Short Peptide
KWKLFKKIPPPKFKKAALKF

SEQ ID NO: 471 - protein, 20 aa, Artificial
  Short Peptide
RWKLFKKIPPPKFKKAALKF

SEQ ID NO: 472 - protein, 20 aa, Artificial
  Short Peptide
FWKLFKKIPPPKFKKAALKF

SEQ ID NO: 473 - protein, 20 aa, Artificial
  Short Peptide
KKKKFKKIPPPKFKKAALKF

SEQ ID NO: 474 - protein, 20 aa, Artificial
  Short Peptide
RKKKFKKIPPPKFKKAALKF

SEQ ID NO: 475 - protein, 20 aa, Artificial
  Short Peptide
FKKKFKKIPPPKFKKAALKF

SEQ ID NO: 476 - protein, 20 aa, Artificial
  Short Peptide
KWKKFKKIPPPKFKKAALKF

SEQ ID NO: 477 - protein, 20 aa, Artificial
  Short Peptide
RWKKFKKIPPPKFKKAALKF

SEQ ID NO: 478 - protein, 20 aa, Artificial
  Short Peptide
FWKKFKKIPPPKFKKAALKF

SEQ ID NO: 479 - protein, 20 aa, Artificial
  Short Peptide
KKKLLKKIPPPKFKKAALKF

SEQ ID NO: 480 - protein, 20 aa, Artificial
  Short Peptide
RKKLLKKIPPPKFKKAALKF

SEQ ID NO: 481 - protein, 20 aa, Artificial
  Short Peptide
FKKLLKKIPPPKFKKAALKF

SEQ ID NO: 482 - protein, 20 aa, Artificial
  Short Peptide
KWKLLKKIPPPKFKKAALKF

SEQ ID NO: 483 - protein, 20 aa, Artificial
  Short Peptide
RWKLLKKIPPPKFKKAALKF

SEQ ID NO: 484 - protein, 20 aa, Artificial
  Short Peptide
FWKLLKKIPPPKFKKAALKF

SEQ ID NO: 485 - protein, 20 aa, Artificial
  Short Peptide
KKKKLKKIPPPKFKKAALKF

SEQ ID NO: 486 - protein, 20 aa, Artificial
  Short Peptide
RKKKLKKIPPPKFKKAALKF

SEQ ID NO: 487 - protein, 20 aa, Artificial
  Short Peptide
FKKKLKKIPPPKFKKAALKF

SEQ ID NO: 488 - protein, 20 aa, Artificial
  Short Peptide
KWKKLKKIPPPKFKKAALKF

SEQ ID NO: 489 - protein, 20 aa, Artificial
  Short Peptide
RWKKLKKIPPPKFKKAALKF

SEQ ID NO: 490 - protein, 20 aa, Artificial
  Short Peptide
FWKKLKKIPPPKFKKAALKF

SEQ ID NO: 491 - protein, 19 aa, Artificial
  Short Peptide
KKKLFLKIPPKFKKAALKF

SEQ ID NO: 492 - protein, 19 aa, Artificial
  Short Peptide
RKKLFLKIPPKFKKAALKF

SEQ ID NO: 493 - protein, 19 aa, Artificial
  Short Peptide
FKKLFLKIPPKFKKAALKF

SEQ ID NO: 494 - protein, 19 aa, Artificial
  Short Peptide
KWKLFLKIPPKFKKAALKF

SEQ ID NO: 495 - protein, 19 aa, Artificial
  Short Peptide
RWKLFLKIPPKFKKAALKF

SEQ ID NO: 496 - protein, 19 aa, Artificial
  Short Peptide
FWKLFLKIPPKFKKAALKF

SEQ ID NO: 497 - protein, 19 aa, Artificial
  Short Peptide
KKKKFLKIPPKFKKAALKF

SEQ ID NO: 498 - protein, 19 aa, Artificial
  Short Peptide
RKKKFLKIPPKFKKAALKF

SEQ ID NO: 499 - protein, 19 aa, Artificial
  Short Peptide
FKKKFLKIPPKFKKAALKF

SEQ ID NO: 500 - protein, 19 aa, Artificial
  Short Peptide
KWKKFLKIPPKFKKAALKF

SEQ ID NO: 501 - protein, 19 aa, Artificial
  Short Peptide
RWKKFLKIPPKFKKAALKF

SEQ ID NO: 502 - protein, 19 aa, Artificial
  Short Peptide
FWKKFLKIPPKFKKAALKF

SEQ ID NO: 503 - protein, 19 aa, Artificial
  Short Peptide
KKKLLLKIPPKFKKAALKF

SEQ ID NO: 504 - protein, 19 aa, Artificial
  Short Peptide
RKKLLLKIPPKFKKAALKF

SEQ ID NO: 505 - protein, 19 aa, Artificial
  Short Peptide
FKKLLLKIPPKFKKAALKF

SEQ ID NO: 506 - protein, 19 aa, Artificial
  Short Peptide
KWKLLLKIPPKFKKAALKF

SEQ ID NO: 507 - protein, 19 aa, Artificial
  Short Peptide
RWKLLLKIPPKFKKAALKF

SEQ ID NO: 508 - protein, 19 aa, Artificial
  Short Peptide
FWKLLLKIPPKFKKAALKF

SEQ ID NO: 509 - protein, 19 aa, Artificial
  Short Peptide
KKKKLLKIPPKFKKAALKF

SEQ ID NO: 510 - protein, 19 aa, Artificial
  Short Peptide
RKKKLLKIPPKFKKAALKF

SEQ ID NO: 511 - protein, 19 aa, Artificial
  Short Peptide
FKKKLLKIPPKFKKAALKF

SEQ ID NO: 512 - protein, 19 aa, Artificial
  Short Peptide
KWKKLLKIPPKFKKAALKF

SEQ ID NO: 513 - protein, 19 aa, Artificial
  Short Peptide
RWKKLLKIPPKFKKAALKF

SEQ ID NO: 514 - protein, 19 aa, Artificial
  Short Peptide
FWKKLLKIPPKFKKAALKF

SEQ ID NO: 515 - protein, 19 aa, Artificial
  Short Peptide
KKKLFKKIPPKFKKAALKF

SEQ ID NO: 516 - protein, 19 aa, Artificial
  Short Peptide
RKKLFKKIPPKFKKAALKF

SEQ ID NO: 517 - protein, 19 aa, Artificial
  Short Peptide
FKKLFKKIPPKFKKAALKF

SEQ ID NO: 518 - protein, 19 aa, Artificial
  Short Peptide
KWKLFKKIPPKFKKAALKF

SEQ ID NO: 519 - protein, 19 aa, Artificial
  Short Peptide
RWKLFKKIPPKFKKAALKF

SEQ ID NO: 520 - protein, 19 aa, Artificial
  Short Peptide
FWKLFKKIPPKFKKAALKF

SEQ ID NO: 521 - protein, 19 aa, Artificial
  Short Peptide
KKKKFKKIPPKFKKAALKF

SEQ ID NO: 522 - protein, 19 aa, Artificial
  Short Peptide
RKKKFKKIPPKFKKAALKF

SEQ ID NO: 523 - protein, 19 aa, Artificial
  Short Peptide
FKKKFKKIPPKFKKAALKF

SEQ ID NO: 524 - protein, 19 aa, Artificial
  Short Peptide
KWKKFKKIPPKFKKAALKF

SEQ ID NO: 525 - protein, 19 aa, Artificial
  Short Peptide
RWKKFKKIPPKFKKAALKF

SEQ ID NO: 526 - protein, 19 aa, Artificial
  Short Peptide
FWKKFKKIPPKFKKAALKF

SEQ ID NO: 527 - protein, 19 aa, Artificial
  Short Peptide
KKKLLKKIPPKFKKAALKF

SEQ ID NO: 528 - protein, 19 aa, Artificial
  Short Peptide
RKKLLKKIPPKFKKAALKF

SEQ ID NO: 529 - protein, 19 aa, Artificial
  Short Peptide
FKKLLKKIPPKFKKAALKF

SEQ ID NO: 530 - protein, 19 aa, Artificial
  Short Peptide
KWKLLKKIPPKFKKAALKF

SEQ ID NO: 531 - protein, 19 aa, Artificial
  Short Peptide
RWKLLKKIPPKFKKAALKF

SEQ ID NO: 532 - protein, 19 aa, Artificial
  Short Peptide
FWKLLKKIPPKFKKAALKF

SEQ ID NO: 533 - protein, 19 aa, Artificial
  Short Peptide
KKKKLKKIPPKFKKAALKF

SEQ ID NO: 534 - protein, 19 aa, Artificial
  Short Peptide
RKKKLKKIPPKFKKAALKF

SEQ ID NO: 535 - protein, 19 aa, Artificial
  Short Peptide
FKKKLKKIPPKFKKAALKF

SEQ ID NO: 536 - protein, 19 aa, Artificial
  Short Peptide
KWKKLKKIPPKFKKAALKF

SEQ ID NO: 537 - protein, 19 aa, Artificial
  Short Peptide
RWKKLKKIPPKFKKAALKF

SEQ ID NO: 538 - protein, 19 aa, Artificial
  Short Peptide
FWKKLKKIPPKFKKAALKF

SEQ ID NO: 539 - protein, 18 aa, Artificial
  Short Peptide
KKKLFLKIPKFKKAALKF

SEQ ID NO: 540 - protein, 18 aa, Artificial
  Short Peptide
RKKLFLKIPKFKKAALKF

SEQ ID NO: 541 - protein, 18 aa, Artificial
  Short Peptide
FKKLFLKIPKFKKAALKF

SEQ ID NO: 542 - protein, 18 aa, Artificial
  Short Peptide
KWKLFLKIPKFKKAALKF

SEQ ID NO: 543 - protein, 18 aa, Artificial
  Short Peptide
RWKLFLKIPKFKKAALKF

SEQ ID NO: 544 - protein, 18 aa, Artificial
  Short Peptide
FWKLFLKIPKFKKAALKF

SEQ ID NO: 545 - protein, 18 aa, Artificial
  Short Peptide
KKKKFLKIPKFKKAALKF

SEQ ID NO: 546 - protein, 18 aa, Artificial
  Short Peptide
RKKKFLKIPKFKKAALKF

SEQ ID NO: 547 - protein, 18 aa, Artificial
  Short Peptide
FKKKFLKIPKFKKAALKF

SEQ ID NO: 548 - protein, 18 aa, Artificial
  Short Peptide
KWKKFLKIPKFKKAALKF

SEQ ID NO: 549 - protein, 18 aa, Artificial
  Short Peptide
RWKKFLKIPKFKKAALKF

SEQ ID NO: 550 - protein, 18 aa, Artificial
  Short Peptide
FWKKFLKIPKFKKAALKF

SEQ ID NO: 551 - protein, 18 aa, Artificial
  Short Peptide
KKKLLLKIPKFKKAALKF

SEQ ID NO: 552 - protein, 18 aa, Artificial
  Short Peptide
RKKLLLKIPKFKKAALKF

SEQ ID NO: 553 - protein, 18 aa, Artificial
  Short Peptide
FKKLLLKIPKFKKAALKF

SEQ ID NO: 554 - protein, 18 aa, Artificial
  Short Peptide
KWKLLLKIPKFKKAALKF

SEQ ID NO: 555 - protein, 18 aa, Artificial
  Short Peptide
RWKLLLKIPKFKKAALKF

SEQ ID NO: 556 - protein, 18 aa, Artificial
  Short Peptide
FWKLLLKIPKFKKAALKF

SEQ ID NO: 557 - protein, 18 aa, Artificial
  Short Peptide
KKKKLLKIPKFKKAALKF

SEQ ID NO: 558 - protein, 18 aa, Artificial
  Short Peptide
RKKKLLKIPKFKKAALKF

SEQ ID NO: 559 - protein, 18 aa, Artificial
  Short Peptide
FKKKLLKIPKFKKAALKF

SEQ ID NO: 560 - protein, 18 aa, Artificial
  Short Peptide
KWKKLLKIPKFKKAALKF

SEQ ID NO: 561 - protein, 18 aa, Artificial
  Short Peptide
RWKKLLKIPKFKKAALKF

SEQ ID NO: 562 - protein, 18 aa, Artificial
  Short Peptide
FWKKLLKIPKFKKAALKF

SEQ ID NO: 563 - protein, 18 aa, Artificial
  Short Peptide
KKKLFKKIPKFKKAALKF

SEQ ID NO: 564 - protein, 18 aa, Artificial
  Short Peptide
RKKLFKKIPKFKKAALKF

SEQ ID NO: 565 - protein, 18 aa, Artificial
  Short Peptide
FKKLFKKIPKFKKAALKF

SEQ ID NO: 566 - protein, 18 aa, Artificial
  Short Peptide
KWKLFKKIPKFKKAALKF

SEQ ID NO: 567 - protein, 18 aa, Artificial
  Short Peptide
RWKLFKKIPKFKKAALKF

SEQ ID NO: 568 - protein, 18 aa, Artificial
  Short Peptide
FWKLFKKIPKFKKAALKF

SEQ ID NO: 569 - protein, 18 aa, Artificial
  Short Peptide
KKKKFKKIPKFKKAALKF

SEQ ID NO: 570 - protein, 18 aa, Artificial
  Short Peptide
RKKKFKKIPKFKKAALKF

SEQ ID NO: 571 - protein, 18 aa, Artificial
  Short Peptide
FKKKFKKIPKFKKAALKF

SEQ ID NO: 572 - protein, 18 aa, Artificial
  Short Peptide
KWKKFKKIPKFKKAALKF

SEQ ID NO: 573 - protein, 18 aa, Artificial
  Short Peptide
RWKKFKKIPKFKKAALKF

SEQ ID NO: 574 - protein, 18 aa, Artificial
  Short Peptide
FWKKFKKIPKFKKAALKF

SEQ ID NO: 575 - protein, 18 aa, Artificial
  Short Peptide
KKKLLKKIPKFKKAALKF

SEQ ID NO: 576 - protein, 18 aa, Artificial
  Short Peptide
RKKLLKKIPKFKKAALKF

SEQ ID NO: 577 - protein, 18 aa, Artificial
  Short Peptide
FKKLLKKIPKFKKAALKF

SEQ ID NO: 578 - protein, 18 aa, Artificial
  Short Peptide
KWKLLKKIPKFKKAALKF

SEQ ID NO: 579 - protein, 18 aa, Artificial
  Short Peptide
RWKLLKKIPKFKKAALKF

SEQ ID NO: 580 - protein, 18 aa, Artificial
  Short Peptide
FWKLLKKIPKFKKAALKF

SEQ ID NO: 581 - protein, 18 aa, Artificial
  Short Peptide
KKKKLKKIPKFKKAALKF

SEQ ID NO: 582 - protein, 18 aa, Artificial
  Short Peptide
RKKKLKKIPKFKKAALKF

SEQ ID NO: 583 - protein, 18 aa, Artificial
  Short Peptide
FKKKLKKIPKFKKAALKF

SEQ ID NO: 584 - protein, 18 aa, Artificial
  Short Peptide
KWKKLKKIPKFKKAALKF

SEQ ID NO: 585 - protein, 18 aa, Artificial
  Short Peptide
RWKKLKKIPKFKKAALKF

SEQ ID NO: 586 - protein, 18 aa, Artificial
  Short Peptide
FWKKLKKIPKFKKAALKF

SEQ ID NO: 587 - protein, 20 aa, Artificial
  Short Peptide
KKKLFLKIPPPKFLHLALKF

SEQ ID NO: 588 - protein, 20 aa, Artificial
  Short Peptide
RKKLFLKIPPPKFLHLALKF

SEQ ID NO: 589 - protein, 20 aa, Artificial
  Short Peptide
FKKLFLKIPPPKFLHLALKF

SEQ ID NO: 590 - protein, 20 aa, Artificial
  Short Peptide
KWKLFLKIPPPKFLHLALKF

SEQ ID NO: 591 - protein, 20 aa, Artificial
  Short Peptide
RWKLFLKIPPPKFLHLALKF

SEQ ID NO: 592 - protein, 20 aa, Artificial
  Short Peptide
FWKLFLKIPPPKFLHLALKF

SEQ ID NO: 593 - protein, 20 aa, Artificial
  Short Peptide
KKKKFLKIPPPKFLHLALKF

SEQ ID NO: 594 - protein, 20 aa, Artificial
  Short Peptide
RKKKFLKIPPPKFLHLALKF

SEQ ID NO: 595 - protein, 20 aa, Artificial
  Short Peptide
FKKKFLKIPPPKFLHLALKF

SEQ ID NO: 596 - protein, 20 aa, Artificial
  Short Peptide
KWKKFLKIPPPKFLHLALKF

SEQ ID NO: 597 - protein, 20 aa, Artificial
  Short Peptide
RWKKFLKIPPPKFLHLALKF

SEQ ID NO: 598 - protein, 20 aa, Artificial
  Short Peptide
FWKKFLKIPPPKFLHLALKF

SEQ ID NO: 599 - protein, 20 aa, Artificial
  Short Peptide
KKKLLLKIPPPKFLHLALKF

SEQ ID NO: 600 - protein, 20 aa, Artificial
  Short Peptide
RKKLLLKIPPPKFLHLALKF

SEQ ID NO: 601 - protein, 20 aa, Artificial
  Short Peptide
FKKLLLKIPPPKFLHLALKF

SEQ ID NO: 602 - protein, 20 aa, Artificial
  Short Peptide
KWKLLLKIPPPKFLHLALKF

SEQ ID NO: 603 - protein, 20 aa, Artificial
  Short Peptide
RWKLLLKIPPPKFLHLALKF

SEQ ID NO: 604 - protein, 20 aa, Artificial
  Short Peptide
FWKLLLKIPPPKFLHLALKF

SEQ ID NO: 605 - protein, 20 aa, Artificial
  Short Peptide
KKKKLLKIPPPKFLHLALKF

SEQ ID NO: 606 - protein, 20 aa, Artificial
  Short Peptide
RKKKLLKIPPPKFLHLALKF

SEQ ID NO: 607 - protein, 20 aa, Artificial
  Short Peptide
FKKKLLKIPPPKFLHLALKF

SEQ ID NO: 608 - protein, 20 aa, Artificial
  Short Peptide
KWKKLLKIPPPKFLHLALKF

SEQ ID NO: 609 - protein, 20 aa, Artificial
  Short Peptide
RWKKLLKIPPPKFLHLALKF

SEQ ID NO: 610 - protein, 20 aa, Artificial
  Short Peptide
FWKKLLKIPPPKFLHLALKF

SEQ ID NO: 611 - protein, 20 aa, Artificial
  Short Peptide
KKKLFKKIPPPKFLHLALKF

SEQ ID NO: 612 - protein, 20 aa, Artificial
  Short Peptide
RKKLFKKIPPPKFLHLALKF

SEQ ID NO: 613 - protein, 20 aa, Artificial
  Short Peptide
FKKLFKKIPPPKFLHLALKF

SEQ ID NO: 614 - protein, 20 aa, Artificial
  Short Peptide
KWKLFKKIPPPKFLHLALKF

SEQ ID NO: 615 - protein, 20 aa, Artificial
  Short Peptide
RWKLFKKIPPPKFLHLALKF

SEQ ID NO: 616 - protein, 20 aa, Artificial
  Short Peptide
FWKLFKKIPPPKFLHLALKF

SEQ ID NO: 617 - protein, 20 aa, Artificial
  Short Peptide
KKKKFKKIPPPKFLHLALKF

SEQ ID NO: 618 - protein, 20 aa, Artificial
  Short Peptide
RKKKFKKIPPPKFLHLALKF

SEQ ID NO: 619 - protein, 20 aa, Artificial
  Short Peptide
FKKKFKKIPPPKFLHLALKF

SEQ ID NO: 620 - protein, 20 aa, Artificial
  Short Peptide
KWKKFKKIPPPKFLHLALKF

SEQ ID NO: 621 - protein, 20 aa, Artificial
  Short Peptide
RWKKFKKIPPPKFLHLALKF

SEQ ID NO: 622 - protein, 20 aa, Artificial
  Short Peptide
FWKKFKKIPPPKFLHLALKF

SEQ ID NO: 623 - protein, 20 aa, Artificial
  Short Peptide
KKKLLKKIPPPKFLHLALKF

SEQ ID NO: 624 - protein, 20 aa, Artificial
  Short Peptide
RKKLLKKIPPPKFLHLALKF

SEQ ID NO: 625 - protein, 20 aa, Artificial
  Short Peptide
FKKLLKKIPPPKFLHLALKF

SEQ ID NO: 626 - protein, 20 aa, Artificial
  Short Peptide
KWKLLKKIPPPKFLHLALKF

SEQ ID NO: 627 - protein, 20 aa, Artificial
  Short Peptide
RWKLLKKIPPPKFLHLALKF

SEQ ID NO: 628 - protein, 20 aa, Artificial
  Short Peptide
FWKLLKKIPPPKFLHLALKF

SEQ ID NO: 629 - protein, 20 aa, Artificial
  Short Peptide
KKKKLKKIPPPKFLHLALKF

SEQ ID NO: 630 - protein, 20 aa, Artificial
  Short Peptide
RKKKLKKIPPPKFLHLALKF

SEQ ID NO: 631 - protein, 20 aa, Artificial
  Short Peptide
FKKKLKKIPPPKFLHLALKF

SEQ ID NO: 632 - protein, 20 aa, Artificial
  Short Peptide
KWKKLKKIPPPKFLHLALKF

SEQ ID NO: 633 - protein, 20 aa, Artificial
  Short Peptide
RWKKLKKIPPPKFLHLALKF

SEQ ID NO: 634 - protein, 20 aa, Artificial
  Short Peptide
FWKKLKKIPPPKFLHLALKF

SEQ ID NO: 635 - protein, 19 aa, Artificial
  Short Peptide
KKKLFLKIPPKFLHLALKF

SEQ ID NO: 636 - protein, 19 aa, Artificial
  Short Peptide
RKKLFLKIPPKFLHLALKF

SEQ ID NO: 637 - protein, 19 aa, Artificial
  Short Peptide
FKKLFLKIPPKFLHLALKF

SEQ ID NO: 638 - protein, 19 aa, Artificial
  Short Peptide
KWKLFLKIPPKFLHLALKF

SEQ ID NO: 639 - protein, 19 aa, Artificial
  Short Peptide
RWKLFLKIPPKFLHLALKF

SEQ ID NO: 640 - protein, 19 aa, Artificial
  Short Peptide
FWKLFLKIPPKFLHLALKF

SEQ ID NO: 641 - protein, 19 aa, Artificial
  Short Peptide
KKKKFLKIPPKFLHLALKF

SEQ ID NO: 642 - protein, 19 aa, Artificial
  Short Peptide
RKKKFLKIPPKFLHLALKF

SEQ ID NO: 643 - protein, 19 aa, Artificial
  Short Peptide
FKKKFLKIPPKFLHLALKF

SEQ ID NO: 644 - protein, 19 aa, Artificial
  Short Peptide
KWKKFLKIPPKFLHLALKF

SEQ ID NO: 645 - protein, 19 aa, Artificial
  Short Peptide
RWKKFLKIPPKFLHLALKF

SEQ ID NO: 646 - protein, 19 aa, Artificial
  Short Peptide
FWKKFLKIPPKFLHLALKF

SEQ ID NO: 647 - protein, 19 aa, Artificial
  Short Peptide
KKKLLLKIPPKFLHLALKF

SEQ ID NO: 648 - protein, 19 aa, Artificial
  Short Peptide
RKKLLLKIPPKFLHLALKF

SEQ ID NO: 649 - protein, 19 aa, Artificial
  Short Peptide
FKKLLLKIPPKFLHLALKF

SEQ ID NO: 650 - protein, 19 aa, Artificial
  Short Peptide
KWKLLLKIPPKFLHLALKF

SEQ ID NO: 651 - protein, 19 aa, Artificial
  Short Peptide
RWKLLLKIPPKFLHLALKF

SEQ ID NO: 652 - protein, 19 aa, Artificial
  Short Peptide
FWKLLLKIPPKFLHLALKF

SEQ ID NO: 653 - protein, 19 aa, Artificial
  Short Peptide
KKKKLLKIPPKFLHLALKF

SEQ ID NO: 654 - protein, 19 aa, Artificial
  Short Peptide
RKKKLLKIPPKFLHLALKF

SEQ ID NO: 655 - protein, 19 aa, Artificial
  Short Peptide
FKKKLLKIPPKFLHLALKF

SEQ ID NO: 656 - protein, 19 aa, Artificial
  Short Peptide
KWKKLLKIPPKFLHLALKF

SEQ ID NO: 657 - protein, 19 aa, Artificial
  Short Peptide
RWKKLLKIPPKFLHLALKF

SEQ ID NO: 658 - protein, 19 aa, Artificial
  Short Peptide
FWKKLLKIPPKFLHLALKF

SEQ ID NO: 659 - protein, 19 aa, Artificial
  Short Peptide
KKKLFKKIPPKFLHLALKF

SEQ ID NO: 660 - protein, 19 aa, Artificial
  Short Peptide
RKKLFKKIPPKFLHLALKF

SEQ ID NO: 661 - protein, 19 aa, Artificial
  Short Peptide
FKKLFKKIPPKFLHLALKF

SEQ ID NO: 662 - protein, 19 aa, Artificial
  Short Peptide
KWKLFKKIPPKFLHLALKF

SEQ ID NO: 663 - protein, 19 aa, Artificial
  Short Peptide
RWKLFKKIPPKFLHLALKF

SEQ ID NO: 664 - protein, 19 aa, Artificial
  Short Peptide
FWKLFKKIPPKFLHLALKF

SEQ ID NO: 665 - protein, 19 aa, Artificial
  Short Peptide
KKKKFKKIPPKFLHLALKF

SEQ ID NO: 666 - protein, 19 aa, Artificial
  Short Peptide
RKKKFKKIPPKFLHLALKF

SEQ ID NO: 667 - protein, 19 aa, Artificial
  Short Peptide
FKKKFKKIPPKFLHLALKF

SEQ ID NO: 668 - protein, 19 aa, Artificial
  Short Peptide
KWKKFKKIPPKFLHLALKF

SEQ ID NO: 669 - protein, 19 aa, Artificial
  Short Peptide
RWKKFKKIPPKFLHLALKF

SEQ ID NO: 670 - protein, 19 aa, Artificial
  Short Peptide
FWKKFKKIPPKFLHLALKF

SEQ ID NO: 671 - protein, 19 aa, Artificial
  Short Peptide
KKKLLKKIPPKFLHLALKF

SEQ ID NO: 672 - protein, 19 aa, Artificial
  Short Peptide
RKKLLKKIPPKFLHLALKF

SEQ ID NO: 673 - protein, 19 aa, Artificial
  Short Peptide
FKKLLKKIPPKFLHLALKF

SEQ ID NO: 674 - protein, 19 aa, Artificial
  Short Peptide
KWKLLKKIPPKFLHLALKF

SEQ ID NO: 675 - protein, 19 aa, Artificial
  Short Peptide
RWKLLKKIPPKFLHLALKF

SEQ ID NO: 676 - protein, 19 aa, Artificial
  Short Peptide
FWKLLKKIPPKFLHLALKF

SEQ ID NO: 677 - protein, 19 aa, Artificial
  Short Peptide
KKKKLKKIPPKFLHLALKF

SEQ ID NO: 678 - protein, 19 aa, Artificial
  Short Peptide
RKKKLKKIPPKFLHLALKF

SEQ ID NO: 679 - protein, 19 aa, Artificial
  Short Peptide
FKKKLKKIPPKFLHLALKF

SEQ ID NO: 680 - protein, 19 aa, Artificial
  Short Peptide
KWKKLKKIPPKFLHLALKF

SEQ ID NO: 681 - protein, 19 aa, Artificial
  Short Peptide
RWKKLKKIPPKFLHLALKF

SEQ ID NO: 682 - protein, 19 aa, Artificial
  Short Peptide
FWKKLKKIPPKFLHLALKF

SEQ ID NO: 683 - protein, 18 aa, Artificial
  Short Peptide
KKKLFLKIPKFLHLALKF

SEQ ID NO: 684 - protein, 18 aa, Artificial
  Short Peptide
RKKLFLKIPKFLHLALKF

SEQ ID NO: 685 - protein, 18 aa, Artificial
  Short Peptide
FKKLFLKIPKFLHLALKF

SEQ ID NO: 686 - protein, 18 aa, Artificial
  Short Peptide
KWKLFLKIPKFLHLALKF

SEQ ID NO: 687 - protein, 18 aa, Artificial
  Short Peptide
RWKLFLKIPKFLHLALKF

SEQ ID NO: 688 - protein, 18 aa, Artificial
  Short Peptide
FWKLFLKIPKFLHLALKF

SEQ ID NO: 689 - protein, 18 aa, Artificial
  Short Peptide
KKKKFLKIPKFLHLALKF

SEQ ID NO: 690 - protein, 18 aa, Artificial
  Short Peptide
RKKKFLKIPKFLHLALKF

SEQ ID NO: 691 - protein, 18 aa, Artificial
  Short Peptide
FKKKFLKIPKFLHLALKF

SEQ ID NO: 692 - protein, 18 aa, Artificial
  Short Peptide
KWKKFLKIPKFLHLALKF

SEQ ID NO: 693 - protein, 18 aa, Artificial
  Short Peptide
RWKKFLKIPKFLHLALKF

SEQ ID NO: 694 - protein, 18 aa, Artificial
  Short Peptide
FWKKFLKIPKFLHLALKF

SEQ ID NO: 695 - protein, 18 aa, Artificial
  Short Peptide
KKKLLLKIPKFLHLALKF

SEQ ID NO: 696 - protein, 18 aa, Artificial
  Short Peptide
RKKLLLKIPKFLHLALKF

SEQ ID NO: 697 - protein, 18 aa, Artificial
  Short Peptide
FKKLLLKIPKFLHLALKF

SEQ ID NO: 698 - protein, 18 aa, Artificial
  Short Peptide
KWKLLLKIPKFLHLALKF

SEQ ID NO: 699 - protein, 18 aa, Artificial
  Short Peptide
RWKLLLKIPKFLHLALKF

SEQ ID NO: 700 - protein, 18 aa, Artificial
  Short Peptide
FWKLLLKIPKFLHLALKF

SEQ ID NO: 701 - protein, 18 aa, Artificial
  Short Peptide
KKKKLLKIPKFLHLALKF

SEQ ID NO: 702 - protein, 18 aa, Artificial
  Short Peptide
RKKKLLKIPKFLHLALKF

SEQ ID NO: 703 - protein, 18 aa, Artificial
  Short Peptide
FKKKLLKIPKFLHLALKF

SEQ ID NO: 704 - protein, 18 aa, Artificial
  Short Peptide
KWKKLLKIPKFLHLALKF

SEQ ID NO: 705 - protein, 18 aa, Artificial
  Short Peptide
RWKKLLKIPKFLHLALKF

SEQ ID NO: 706 - protein, 18 aa, Artificial
  Short Peptide
FWKKLLKIPKFLHLALKF

SEQ ID NO: 707 - protein, 18 aa, Artificial
  Short Peptide
KKKLFKKIPKFLHLALKF

SEQ ID NO: 708 - protein, 18 aa, Artificial
  Short Peptide
RKKLFKKIPKFLHLALKF

SEQ ID NO: 709 - protein, 18 aa, Artificial
  Short Peptide
FKKLFKKIPKFLHLALKF

SEQ ID NO: 710 - protein, 18 aa, Artificial
  Short Peptide
KWKLFKKIPKFLHLALKF

SEQ ID NO: 711 - protein, 18 aa, Artificial
  Short Peptide
RWKLFKKIPKFLHLALKF

SEQ ID NO: 712 - protein, 18 aa, Artificial
  Short Peptide
FWKLFKKIPKFLHLALKF

SEQ ID NO: 713 - protein, 18 aa, Artificial
  Short Peptide
KKKKFKKIPKFLHLALKF

SEQ ID NO: 714 - protein, 18 aa, Artificial
  Short Peptide
RKKKFKKIPKFLHLALKF

SEQ ID NO: 715 - protein, 18 aa, Artificial
  Short Peptide
FKKKFKKIPKFLHLALKF

SEQ ID NO: 716 - protein, 18 aa, Artificial
  Short Peptide
KWKKFKKIPKFLHLALKF

SEQ ID NO: 717 - protein, 18 aa, Artificial
  Short Peptide
RWKKFKKIPKFLHLALKF

SEQ ID NO: 718 - protein, 18 aa, Artificial
  Short Peptide
FWKKFKKIPKFLHLALKF

SEQ ID NO: 719 - protein, 18 aa, Artificial
  Short Peptide
KKKLLKKIPKFLHLALKF

SEQ ID NO: 720 - protein, 18 aa, Artificial
  Short Peptide
RKKLLKKIPKFLHLALKF

SEQ ID NO: 721 - protein, 18 aa, Artificial
  Short Peptide
FKKLLKKIPKFLHLALKF

SEQ ID NO: 722 - protein, 18 aa, Artificial
  Short Peptide
KWKLLKKIPKFLHLALKF

SEQ ID NO: 723 - protein, 18 aa, Artificial
  Short Peptide
RWKLLKKIPKFLHLALKF

SEQ ID NO: 724 - protein, 18 aa, Artificial
  Short Peptide
FWKLLKKIPKFLHLALKF

SEQ ID NO: 725 - protein, 18 aa, Artificial
  Short Peptide
KKKKLKKIPKFLHLALKF

SEQ ID NO: 726 - protein, 18 aa, Artificial
  Short Peptide
RKKKLKKIPKFLHLALKF

SEQ ID NO: 727 - protein, 18 aa, Artificial
  Short Peptide
FKKKLKKIPKFLHLALKF

SEQ ID NO: 728 - protein, 18 aa, Artificial
  Short Peptide
KWKKLKKIPKFLHLALKF

SEQ ID NO: 729 - protein, 18 aa, Artificial
  Short Peptide
RWKKLKKIPKFLHLALKF

SEQ ID NO: 730 - protein, 18 aa, Artificial
  Short Peptide
FWKKLKKIPKFLHLALKF

SEQ ID NO: 731 - protein, 20 aa, Artificial
  Short Peptide
KKKLFLKIPPPKFKHLALKF

SEQ ID NO: 732 - protein, 20 aa, Artificial
  Short Peptide
RKKLFLKIPPPKFKHLALKF

SEQ ID NO: 733 - protein, 20 aa, Artificial
  Short Peptide
FKKLFLKIPPPKFKHLALKF

SEQ ID NO: 734 - protein, 20 aa, Artificial
  Short Peptide
KWKLFLKIPPPKFKHLALKF

SEQ ID NO: 735 - protein, 20 aa, Artificial
  Short Peptide
RWKLFLKIPPPKFKHLALKF

SEQ ID NO: 736 - protein, 20 aa, Artificial
  Short Peptide
FWKLFLKIPPPKFKHLALKF

SEQ ID NO: 737 - protein, 20 aa, Artificial
  Short Peptide
KKKKFLKIPPPKFKHLALKF

SEQ ID NO: 738 - protein, 20 aa, Artificial
  Short Peptide
RKKKFLKIPPPKFKHLALKF

SEQ ID NO: 739 - protein, 20 aa, Artificial
  Short Peptide
FKKKFLKIPPPKFKHLALKF

SEQ ID NO: 740 - protein, 20 aa, Artificial
  Short Peptide
KWKKFLKIPPPKFKHLALKF

SEQ ID NO: 741 - protein, 20 aa, Artificial
  Short Peptide
RWKKFLKIPPPKFKHLALKF

SEQ ID NO: 742 - protein, 20 aa, Artificial
  Short Peptide
FWKKFLKIPPPKFKHLALKF

SEQ ID NO: 743 - protein, 20 aa, Artificial
  Short Peptide
KKKLLLKIPPPKFKHLALKF

SEQ ID NO: 744 - protein, 20 aa, Artificial
  Short Peptide
RKKLLLKIPPPKFKHLALKF

SEQ ID NO: 745 - protein, 20 aa, Artificial
  Short Peptide
FKKLLLKIPPPKFKHLALKF

SEQ ID NO: 746 - protein, 20 aa, Artificial
  Short Peptide
KWKLLLKIPPPKFKHLALKF

SEQ ID NO: 747 - protein, 20 aa, Artificial
  Short Peptide
RWKLLLKIPPPKFKHLALKF

SEQ ID NO: 748 - protein, 20 aa, Artificial
  Short Peptide
FWKLLLKIPPPKFKHLALKF

SEQ ID NO: 749 - protein, 20 aa, Artificial
  Short Peptide
KKKKLLKIPPPKFKHLALKF

SEQ ID NO: 750 - protein, 20 aa, Artificial
  Short Peptide
RKKKLLKIPPPKFKHLALKF

SEQ ID NO: 751 - protein, 20 aa, Artificial
  Short Peptide
FKKKLLKIPPPKFKHLALKF

SEQ ID NO: 752 - protein, 20 aa, Artificial
  Short Peptide
KWKKLLKIPPPKFKHLALKF

SEQ ID NO: 753 - protein, 20 aa, Artificial
  Short Peptide
RWKKLLKIPPPKFKHLALKF

SEQ ID NO: 754 - protein, 20 aa, Artificial
  Short Peptide
FWKKLLKIPPPKFKHLALKF

SEQ ID NO: 755 - protein, 20 aa, Artificial
  Short Peptide
KKKLFKKIPPPKFKHLALKF

SEQ ID NO: 756 - protein, 20 aa, Artificial
  Short Peptide
RKKLFKKIPPPKFKHLALKF

SEQ ID NO: 757 - protein, 20 aa, Artificial
  Short Peptide
FKKLFKKIPPPKFKHLALKF

SEQ ID NO: 758 - protein, 20 aa, Artificial
  Short Peptide
KWKLFKKIPPPKFKHLALKF

SEQ ID NO: 759 - protein, 20 aa, Artificial
  Short Peptide
RWKLFKKIPPPKFKHLALKF

SEQ ID NO: 760 - protein, 20 aa, Artificial
  Short Peptide
FWKLFKKIPPPKFKHLALKF

SEQ ID NO: 761 - protein, 20 aa, Artificial
  Short Peptide
KKKKFKKIPPPKFKHLALKF

SEQ ID NO: 762 - protein, 20 aa, Artificial
  Short Peptide
RKKKFKKIPPPKFKHLALKF

SEQ ID NO: 763 - protein, 20 aa, Artificial
  Short Peptide
FKKKFKKIPPPKFKHLALKF

SEQ ID NO: 764 - protein, 20 aa, Artificial
  Short Peptide
KWKKFKKIPPPKFKHLALKF

SEQ ID NO: 765 - protein, 20 aa, Artificial
  Short Peptide
RWKKFKKIPPPKFKHLALKF

SEQ ID NO: 766 - protein, 20 aa, Artificial
  Short Peptide
FWKKFKKIPPPKFKHLALKF

SEQ ID NO: 767 - protein, 20 aa, Artificial
  Short Peptide
KKKLLKKIPPPKFKHLALKF

SEQ ID NO: 768 - protein, 20 aa, Artificial
  Short Peptide
RKKLLKKIPPPKFKHLALKF

SEQ ID NO: 769 - protein, 20 aa, Artificial
  Short Peptide
FKKLLKKIPPPKFKHLALKF

SEQ ID NO: 770 - protein, 20 aa, Artificial
  Short Peptide
KWKLLKKIPPPKFKHLALKF

SEQ ID NO: 771 - protein, 20 aa, Artificial
  Short Peptide
RWKLLKKIPPPKFKHLALKF

SEQ ID NO: 772 - protein, 20 aa, Artificial
  Short Peptide
FWKLLKKIPPPKFKHLALKF

SEQ ID NO: 773 - protein, 20 aa, Artificial
  Short Peptide
KKKKLKKIPPPKFKHLALKF

SEQ ID NO: 774 - protein, 20 aa, Artificial
  Short Peptide
RKKKLKKIPPPKFKHLALKF

SEQ ID NO: 775 - protein, 20 aa, Artificial
  Short Peptide
FKKKLKKIPPPKFKHLALKF

SEQ ID NO: 776 - protein, 20 aa, Artificial
  Short Peptide
KWKKLKKIPPPKFKHLALKF

SEQ ID NO: 777 - protein, 20 aa, Artificial
  Short Peptide
RWKKLKKIPPPKFKHLALKF

SEQ ID NO: 778 - protein, 20 aa, Artificial
  Short Peptide
FWKKLKKIPPPKFKHLALKF

SEQ ID NO: 779 - protein, 19 aa, Artificial
  Short Peptide
KKKLFLKIPPKFKHLALKF

SEQ ID NO: 780 - protein, 19 aa, Artificial
  Short Peptide
RKKLFLKIPPKFKHLALKF

SEQ ID NO: 781 - protein, 19 aa, Artificial
  Short Peptide
FKKLFLKIPPKFKHLALKF

SEQ ID NO: 782 - protein, 19 aa, Artificial
  Short Peptide
KWKLFLKIPPKFKHLALKF

SEQ ID NO: 783 - protein, 19 aa, Artificial
  Short Peptide
RWKLFLKIPPKFKHLALKF

SEQ ID NO: 784 - protein, 19 aa, Artificial
  Short Peptide
FWKLFLKIPPKFKHLALKF

SEQ ID NO: 785 - protein, 19 aa, Artificial
  Short Peptide
KKKKFLKIPPKFKHLALKF

SEQ ID NO: 786 - protein, 19 aa, Artificial
  Short Peptide
RKKKFLKIPPKFKHLALKF

SEQ ID NO: 787 - protein, 19 aa, Artificial
  Short Peptide
FKKKFLKIPPKFKHLALKF

SEQ ID NO: 788 - protein, 19 aa, Artificial
  Short Peptide
KWKKFLKIPPKFKHLALKF

SEQ ID NO: 789 - protein, 19 aa, Artificial
  Short Peptide
RWKKFLKIPPKFKHLALKF

SEQ ID NO: 790 - protein, 19 aa, Artificial
  Short Peptide
FWKKFLKIPPKFKHLALKF

SEQ ID NO: 791 - protein, 19 aa, Artificial
  Short Peptide
KKKLLLKIPPKFKHLALKF

SEQ ID NO: 792 - protein, 19 aa, Artificial
  Short Peptide
RKKLLLKIPPKFKHLALKF

SEQ ID NO: 793 - protein, 19 aa, Artificial
  Short Peptide
FKKLLLKIPPKFKHLALKF

SEQ ID NO: 794 - protein, 19 aa, Artificial
  Short Peptide
KWKLLLKIPPKFKHLALKF

SEQ ID NO: 795 - protein, 19 aa, Artificial
  Short Peptide
RWKLLLKIPPKFKHLALKF

SEQ ID NO: 796 - protein, 19 aa, Artificial
  Short Peptide
FWKLLLKIPPKFKHLALKF

SEQ ID NO: 797 - protein, 19 aa, Artificial
  Short Peptide
KKKKLLKIPPKFKHLALKF

SEQ ID NO: 798 - protein, 19 aa, Artificial
  Short Peptide
RKKKLLKIPPKFKHLALKF

SEQ ID NO: 799 - protein, 19 aa, Artificial
  Short Peptide
FKKKLLKIPPKFKHLALKF

SEQ ID NO: 800 - protein, 19 aa, Artificial
  Short Peptide
KWKKLLKIPPKFKHLALKF

SEQ ID NO: 801 - protein, 19 aa, Artificial
  Short Peptide
RWKKLLKIPPKFKHLALKF

SEQ ID NO: 802 - protein, 19 aa, Artificial
  Short Peptide
FWKKLLKIPPKFKHLALKF

SEQ ID NO: 803 - protein, 19 aa, Artificial
  Short Peptide
KKKLFKKIPPKFKHLALKF

SEQ ID NO: 804 - protein, 19 aa, Artificial
  Short Peptide
RKKLFKKIPPKFKHLALKF

SEQ ID NO: 805 - protein, 19 aa, Artificial
  Short Peptide
FKKLFKKIPPKFKHLALKF

SEQ ID NO: 806 - protein, 19 aa, Artificial
  Short Peptide
KWKLFKKIPPKFKHLALKF

SEQ ID NO: 807 - protein, 19 aa, Artificial
  Short Peptide
RWKLFKKIPPKFKHLALKF

SEQ ID NO: 808 - protein, 19 aa, Artificial
  Short Peptide
FWKLFKKIPPKFKHLALKF

SEQ ID NO: 809 - protein, 19 aa, Artificial
  Short Peptide
KKKKFKKIPPKFKHLALKF

SEQ ID NO: 810 - protein, 19 aa, Artificial
  Short Peptide
RKKKFKKIPPKFKHLALKF

SEQ ID NO: 811 - protein, 19 aa, Artificial
  Short Peptide
FKKKFKKIPPKFKHLALKF

SEQ ID NO: 812 - protein, 19 aa, Artificial
  Short Peptide
KWKKFKKIPPKFKHLALKF

SEQ ID NO: 813 - protein, 19 aa, Artificial
  Short Peptide
RWKKFKKIPPKFKHLALKF

SEQ ID NO: 814 - protein, 19 aa, Artificial
  Short Peptide
FWKKFKKIPPKFKHLALKF

SEQ ID NO: 815 - protein, 19 aa, Artificial
  Short Peptide
KKKLLKKIPPKFKHLALKF

SEQ ID NO: 816 - protein, 19 aa, Artificial
  Short Peptide
RKKLLKKIPPKFKHLALKF

SEQ ID NO: 817 - protein, 19 aa, Artificial
  Short Peptide
FKKLLKKIPPKFKHLALKF

SEQ ID NO: 818 - protein, 19 aa, Artificial
  Short Peptide
KWKLLKKIPPKFKHLALKF

SEQ ID NO: 819 - protein, 19 aa, Artificial
  Short Peptide
RWKLLKKIPPKFKHLALKF

SEQ ID NO: 820 - protein, 19 aa, Artificial
  Short Peptide
FWKLLKKIPPKFKHLALKF

SEQ ID NO: 821 - protein, 19 aa, Artificial
  Short Peptide
KKKKLKKIPPKFKHLALKF

SEQ ID NO: 822 - protein, 19 aa, Artificial
  Short Peptide
RKKKLKKIPPKFKHLALKF

SEQ ID NO: 823 - protein, 19 aa, Artificial
  Short Peptide
FKKKLKKIPPKFKHLALKF

SEQ ID NO: 824 - protein, 19 aa, Artificial
  Short Peptide
KWKKLKKIPPKFKHLALKF

SEQ ID NO: 825 - protein, 19 aa, Artificial
  Short Peptide
RWKKLKKIPPKFKHLALKF

SEQ ID NO: 826 - protein, 19 aa, Artificial
  Short Peptide
FWKKLKKIPPKFKHLALKF

SEQ ID NO: 827 - protein, 18 aa, Artificial
  Short Peptide
KKKLFLKIPKFKHLALKF

SEQ ID NO: 828 - protein, 18 aa, Artificial
  Short Peptide
RKKLFLKIPKFKHLALKF

SEQ ID NO: 829 - protein, 18 aa, Artificial
  Short Peptide
FKKLFLKIPKFKHLALKF

SEQ ID NO: 830 - protein, 18 aa, Artificial
  Short Peptide
KWKLFLKIPKFKHLALKF

SEQ ID NO: 831 - protein, 18 aa, Artificial
  Short Peptide
RWKLFLKIPKFKHLALKF

SEQ ID NO: 832 - protein, 18 aa, Artificial
  Short Peptide
FWKLFLKIPKFKHLALKF

SEQ ID NO: 833 - protein, 18 aa, Artificial
  Short Peptide
KKKKFLKIPKFKHLALKF

SEQ ID NO: 834 - protein, 18 aa, Artificial
  Short Peptide
RKKKFLKIPKFKHLALKF

SEQ ID NO: 835 - protein, 18 aa, Artificial
  Short Peptide
FKKKFLKIPKFKHLALKF

SEQ ID NO: 836 - protein, 18 aa, Artificial
  Short Peptide
KWKKFLKIPKFKHLALKF

SEQ ID NO: 837 - protein, 18 aa, Artificial
  Short Peptide
RWKKFLKIPKFKHLALKF

SEQ ID NO: 838 - protein, 18 aa, Artificial
  Short Peptide
FWKKFLKIPKFKHLALKF

SEQ ID NO: 839 - protein, 18 aa, Artificial
  Short Peptide
KKKLLLKIPKFKHLALKF

SEQ ID NO: 840 - protein, 18 aa, Artificial
  Short Peptide
RKKLLLKIPKFKHLALKF

SEQ ID NO: 841 - protein, 18 aa, Artificial
  Short Peptide
FKKLLLKIPKFKHLALKF

SEQ ID NO: 842 - protein, 18 aa, Artificial
  Short Peptide
KWKLLLKIPKFKHLALKF

SEQ ID NO: 843 - protein, 18 aa, Artificial
  Short Peptide
RWKLLLKIPKFKHLALKF

SEQ ID NO: 844 - protein, 18 aa, Artificial
  Short Peptide
FWKLLLKIPKFKHLALKF

SEQ ID NO: 845 - protein, 18 aa, Artificial
  Short Peptide
KKKKLLKIPKFKHLALKF

SEQ ID NO: 846 - protein, 18 aa, Artificial
  Short Peptide
RKKKLLKIPKFKHLALKF

SEQ ID NO: 847 - protein, 18 aa, Artificial
  Short Peptide
FKKKLLKIPKFKHLALKF

SEQ ID NO: 848 - protein, 18 aa, Artificial
  Short Peptide
KWKKLLKIPKFKHLALKF

SEQ ID NO: 849 - protein, 18 aa, Artificial
  Short Peptide
RWKKLLKIPKFKHLALKF

SEQ ID NO: 850 - protein, 18 aa, Artificial
  Short Peptide
FWKKLLKIPKFKHLALKF

SEQ ID NO: 851 - protein, 18 aa, Artificial
  Short Peptide
KKKLFKKIPKFKHLALKF

SEQ ID NO: 852 - protein, 18 aa, Artificial
  Short Peptide
RKKLFKKIPKFKHLALKF

SEQ ID NO: 853 - protein, 18 aa, Artificial
  Short Peptide
FKKLFKKIPKFKHLALKF

SEQ ID NO: 854 - protein, 18 aa, Artificial
  Short Peptide
KWKLFKKIPKFKHLALKF

SEQ ID NO: 855 - protein, 18 aa, Artificial
  Short Peptide
RWKLFKKIPKFKHLALKF

SEQ ID NO: 856 - protein, 18 aa, Artificial
  Short Peptide
FWKLFKKIPKFKHLALKF

SEQ ID NO: 857 - protein, 18 aa, Artificial
  Short Peptide
KKKKFKKIPKFKHLALKF

SEQ ID NO: 858 - protein, 18 aa, Artificial
  Short Peptide
RKKKFKKIPKFKHLALKF

SEQ ID NO: 859 - protein, 18 aa, Artificial
  Short Peptide
FKKKFKKIPKFKHLALKF

SEQ ID NO: 860 - protein, 18 aa, Artificial
  Short Peptide
KWKKFKKIPKFKHLALKF

SEQ ID NO: 861 - protein, 18 aa, Artificial
  Short Peptide
RWKKFKKIPKFKHLALKF

SEQ ID NO: 862 - protein, 18 aa, Artificial
  Short Peptide
FWKKFKKIPKFKHLALKF

SEQ ID NO: 863 - protein, 18 aa, Artificial
  Short Peptide
KKKLLKKIPKFKHLALKF

SEQ ID NO: 864 - protein, 18 aa, Artificial
  Short Peptide
RKKLLKKIPKFKHLALKF

SEQ ID NO: 865 - protein, 18 aa, Artificial
  Short Peptide
FKKLLKKIPKFKHLALKF

SEQ ID NO: 866 - protein, 18 aa, Artificial
  Short Peptide
KWKLLKKIPKFKHLALKF

SEQ ID NO: 867 - protein, 18 aa, Artificial
  Short Peptide
RWKLLKKIPKFKHLALKF

SEQ ID NO: 868 - protein, 18 aa, Artificial
  Short Peptide
FWKLLKKIPKFKHLALKF

SEQ ID NO: 869 - protein, 18 aa, Artificial
  Short Peptide
KKKKLKKIPKFKHLALKF

SEQ ID NO: 870 - protein, 18 aa, Artificial
  Short Peptide
RKKKLKKIPKFKHLALKF

SEQ ID NO: 871 - protein, 18 aa, Artificial
  Short Peptide
FKKKLKKIPKFKHLALKF

SEQ ID NO: 872 - protein, 18 aa, Artificial
  Short Peptide
KWKKLKKIPKFKHLALKF

SEQ ID NO: 873 - protein, 18 aa, Artificial
  Short Peptide
RWKKLKKIPKFKHLALKF

SEQ ID NO: 874 - protein, 18 aa, Artificial
  Short Peptide
FWKKLKKIPKFKHLALKF

SEQ ID NO: 875 - protein, 20 aa, Artificial
  Short Peptide
KKKLFLKIPPPKFLKLALKF

SEQ ID NO: 876 - protein, 20 aa, Artificial
  Short Peptide
RKKLFLKIPPPKFLKLALKF

SEQ ID NO: 877 - protein, 20 aa, Artificial
  Short Peptide
FKKLFLKIPPPKFLKLALKF

SEQ ID NO: 878 - protein, 20 aa, Artificial
  Short Peptide
KWKLFLKIPPPKFLKLALKF

SEQ ID NO: 879 - protein, 20 aa, Artificial
  Short Peptide
RWKLFLKIPPPKFLKLALKF

SEQ ID NO: 880 - protein, 20 aa, Artificial
  Short Peptide
FWKLFLKIPPPKFLKLALKF

SEQ ID NO: 881 - protein, 20 aa, Artificial
  Short Peptide
KKKKFLKIPPPKFLKLALKF

SEQ ID NO: 882 - protein, 20 aa, Artificial
  Short Peptide
RKKKFLKIPPPKFLKLALKF

SEQ ID NO: 883 - protein, 20 aa, Artificial
  Short Peptide
FKKKFLKIPPPKFLKLALKF

SEQ ID NO: 884 - protein, 20 aa, Artificial
  Short Peptide
KWKKFLKIPPPKFLKLALKF

SEQ ID NO: 885 - protein, 20 aa, Artificial
  Short Peptide
RWKKFLKIPPPKFLKLALKF

SEQ ID NO: 886 - protein, 20 aa, Artificial
  Short Peptide
FWKKFLKIPPPKFLKLALKF

SEQ ID NO: 887 - protein, 20 aa, Artificial
  Short Peptide
KKKLLLKIPPPKFLKLALKF

SEQ ID NO: 888 - protein, 20 aa, Artificial
  Short Peptide
RKKLLLKIPPPKFLKLALKF

SEQ ID NO: 889 - protein, 20 aa, Artificial
  Short Peptide
FKKLLLKIPPPKFLKLALKF

SEQ ID NO: 890 - protein, 20 aa, Artificial
  Short Peptide
KWKLLLKIPPPKFLKLALKF

SEQ ID NO: 891 - protein, 20 aa, Artificial
  Short Peptide
RWKLLLKIPPPKFLKLALKF

SEQ ID NO: 892 - protein, 20 aa, Artificial
  Short Peptide
FWKLLLKIPPPKFLKLALKF

SEQ ID NO: 893 - protein, 20 aa, Artificial
  Short Peptide
KKKKLLKIPPPKFLKLALKF

SEQ ID NO: 894 - protein, 20 aa, Artificial
  Short Peptide
RKKKLLKIPPPKFLKLALKF

SEQ ID NO: 895 - protein, 20 aa, Artificial
  Short Peptide
FKKKLLKIPPPKFLKLALKF

SEQ ID NO: 896 - protein, 20 aa, Artificial
  Short Peptide
KWKKLLKIPPPKFLKLALKF

SEQ ID NO: 897 - protein, 20 aa, Artificial
  Short Peptide
RWKKLLKIPPPKFLKLALKF

SEQ ID NO: 898 - protein, 20 aa, Artificial
  Short Peptide
FWKKLLKIPPPKFLKLALKF

SEQ ID NO: 899 - protein, 20 aa, Artificial
  Short Peptide
KKKLFKKIPPPKFLKLALKF

SEQ ID NO: 900 - protein, 20 aa, Artificial
  Short Peptide
RKKLFKKIPPPKFLKLALKF

SEQ ID NO: 901 - protein, 20 aa, Artificial
  Short Peptide
FKKLFKKIPPPKFLKLALKF

SEQ ID NO: 902 - protein, 20 aa, Artificial
  Short Peptide
KWKLFKKIPPPKFLKLALKF

SEQ ID NO: 903 - protein, 20 aa, Artificial
  Short Peptide
RWKLFKKIPPPKFLKLALKF

SEQ ID NO: 904 - protein, 20 aa, Artificial
  Short Peptide
FWKLFKKIPPPKFLKLALKF

SEQ ID NO: 905 - protein, 20 aa, Artificial
  Short Peptide
KKKKFKKIPPPKFLKLALKF

SEQ ID NO: 906 - protein, 20 aa, Artificial
  Short Peptide
RKKKFKKIPPPKFLKLALKF

SEQ ID NO: 907 - protein, 20 aa, Artificial
  Short Peptide
FKKKFKKIPPPKFLKLALKF

SEQ ID NO: 908 - protein, 20 aa, Artificial
  Short Peptide
KWKKFKKIPPPKFLKLALKF

SEQ ID NO: 909 - protein, 20 aa, Artificial
  Short Peptide
RWKKFKKIPPPKFLKLALKF

SEQ ID NO: 910 - protein, 20 aa, Artificial
  Short Peptide
FWKKFKKIPPPKFLKLALKF

SEQ ID NO: 911 - protein, 20 aa, Artificial
  Short Peptide
KKKLLKKIPPPKFLKLALKF

SEQ ID NO: 912 - protein, 20 aa, Artificial
  Short Peptide
RKKLLKKIPPPKFLKLALKF

SEQ ID NO: 913 - protein, 20 aa, Artificial
  Short Peptide
FKKLLKKIPPPKFLKLALKF

SEQ ID NO: 914 - protein, 20 aa, Artificial
  Short Peptide
KWKLLKKIPPPKFLKLALKF

SEQ ID NO: 915 - protein, 20 aa, Artificial
  Short Peptide
RWKLLKKIPPPKFLKLALKF

SEQ ID NO: 916 - protein, 20 aa, Artificial
  Short Peptide
FWKLLKKIPPPKFLKLALKF

SEQ ID NO: 917 - protein, 20 aa, Artificial
  Short Peptide
KKKKLKKIPPPKFLKLALKF

SEQ ID NO: 918 - protein, 20 aa, Artificial
  Short Peptide
RKKKLKKIPPPKFLKLALKF

SEQ ID NO: 919 - protein, 20 aa, Artificial
  Short Peptide
FKKKLKKIPPPKFLKLALKF

SEQ ID NO: 920 - protein, 20 aa, Artificial
  Short Peptide
KWKKLKKIPPPKFLKLALKF

SEQ ID NO: 921 - protein, 20 aa, Artificial
  Short Peptide
RWKKLKKIPPPKFLKLALKF

SEQ ID NO: 922 - protein, 20 aa, Artificial
  Short Peptide
FWKKLKKIPPPKFLKLALKF

SEQ ID NO: 923 - protein, 19 aa, Artificial
  Short Peptide
KKKLFLKIPPKFLKLALKF

SEQ ID NO: 924 - protein, 19 aa, Artificial
  Short Peptide
RKKLFLKIPPKFLKLALKF

SEQ ID NO: 925 - protein, 19 aa, Artificial
  Short Peptide
FKKLFLKIPPKFLKLALKF

SEQ ID NO: 926 - protein, 19 aa, Artificial
  Short Peptide
KWKLFLKIPPKFLKLALKF

SEQ ID NO: 927 - protein, 19 aa, Artificial
  Short Peptide
RWKLFLKIPPKFLKLALKF

SEQ ID NO: 928 - protein, 19 aa, Artificial
  Short Peptide
FWKLFLKIPPKFLKLALKF

SEQ ID NO: 929 - protein, 19 aa, Artificial
  Short Peptide
KKKKFLKIPPKFLKLALKF

SEQ ID NO: 930 - protein, 19 aa, Artificial
  Short Peptide
RKKKFLKIPPKFLKLALKF

SEQ ID NO: 931 - protein, 19 aa, Artificial
  Short Peptide
FKKKFLKIPPKFLKLALKF

SEQ ID NO: 932 - protein, 19 aa, Artificial
  Short Peptide
KWKKFLKIPPKFLKLALKF

SEQ ID NO: 933 - protein, 19 aa, Artificial
  Short Peptide
RWKKFLKIPPKFLKLALKF

SEQ ID NO: 934 - protein, 19 aa, Artificial
  Short Peptide
FWKKFLKIPPKFLKLALKF

SEQ ID NO: 935 - protein, 19 aa, Artificial
  Short Peptide
KKKLLLKIPPKFLKLALKF

SEQ ID NO: 936 - protein, 19 aa, Artificial
  Short Peptide
RKKLLLKIPPKFLKLALKF

SEQ ID NO: 937 - protein, 19 aa, Artificial
  Short Peptide
FKKLLLKIPPKFLKLALKF

SEQ ID NO: 938 - protein, 19 aa, Artificial
  Short Peptide
KWKLLLKIPPKFLKLALKF

SEQ ID NO: 939 - protein, 19 aa, Artificial
  Short Peptide
RWKLLLKIPPKFLKLALKF

SEQ ID NO: 940 - protein, 19 aa, Artificial
  Short Peptide
FWKLLLKIPPKFLKLALKF

SEQ ID NO: 941 - protein, 19 aa, Artificial
  Short Peptide
KKKKLLKIPPKFLKLALKF

SEQ ID NO: 942 - protein, 19 aa, Artificial
  Short Peptide
RKKKLLKIPPKFLKLALKF

SEQ ID NO: 943 - protein, 19 aa, Artificial
  Short Peptide
FKKKLLKIPPKFLKLALKF

SEQ ID NO: 944 - protein, 19 aa, Artificial
  Short Peptide
KWKKLLKIPPKFLKLALKF

SEQ ID NO: 945 - protein, 19 aa, Artificial
  Short Peptide
RWKKLLKIPPKFLKLALKF

SEQ ID NO: 946 - protein, 19 aa, Artificial
  Short Peptide
FWKKLLKIPPKFLKLALKF

SEQ ID NO: 947 - protein, 19 aa, Artificial
  Short Peptide
KKKLFKKIPPKFLKLALKF

SEQ ID NO: 948 - protein, 19 aa, Artificial
  Short Peptide
RKKLFKKIPPKFLKLALKF

SEQ ID NO: 949 - protein, 19 aa, Artificial
  Short Peptide
FKKLFKKIPPKFLKLALKF

SEQ ID NO: 950 - protein, 19 aa, Artificial
  Short Peptide
KWKLFKKIPPKFLKLALKF

SEQ ID NO: 951 - protein, 19 aa, Artificial
  Short Peptide
RWKLFKKIPPKFLKLALKF

SEQ ID NO: 952 - protein, 19 aa, Artificial
  Short Peptide
FWKLFKKIPPKFLKLALKF

SEQ ID NO: 953 - protein, 19 aa, Artificial
  Short Peptide
KKKKFKKIPPKFLKLALKF

SEQ ID NO: 954 - protein, 19 aa, Artificial
  Short Peptide
RKKKFKKIPPKFLKLALKF

SEQ ID NO: 955 - protein, 19 aa, Artificial
  Short Peptide
FKKKFKKIPPKFLKLALKF

SEQ ID NO: 956 - protein, 19 aa, Artificial
  Short Peptide
KWKKFKKIPPKFLKLALKF

SEQ ID NO: 957 - protein, 19 aa, Artificial
  Short Peptide
RWKKFKKIPPKFLKLALKF

SEQ ID NO: 958 - protein, 19 aa, Artificial
  Short Peptide
FWKKFKKIPPKFLKLALKF

SEQ ID NO: 959 - protein, 19 aa, Artificial
  Short Peptide
KKKLLKKIPPKFLKLALKF

SEQ ID NO: 960 - protein, 19 aa, Artificial
  Short Peptide
RKKLLKKIPPKFLKLALKF

SEQ ID NO: 961 - protein, 19 aa, Artificial
  Short Peptide
FKKLLKKIPPKFLKLALKF

SEQ ID NO: 962 - protein, 19 aa, Artificial
  Short Peptide
KWKLLKKIPPKFLKLALKF

SEQ ID NO: 963 - protein, 19 aa, Artificial
  Short Peptide
RWKLLKKIPPKFLKLALKF

SEQ ID NO: 964 - protein, 19 aa, Artificial
  Short Peptide
FWKLLKKIPPKFLKLALKF

SEQ ID NO: 965 - protein, 19 aa, Artificial
  Short Peptide
KKKKLKKIPPKFLKLALKF

SEQ ID NO: 966 - protein, 19 aa, Artificial
  Short Peptide
RKKKLKKIPPKFLKLALKF

SEQ ID NO: 967 - protein, 19 aa, Artificial
  Short Peptide
FKKKLKKIPPKFLKLALKF

SEQ ID NO: 968 - protein, 19 aa, Artificial
  Short Peptide
KWKKLKKIPPKFLKLALKF

SEQ ID NO: 969 - protein, 19 aa, Artificial
  Short Peptide
RWKKLKKIPPKFLKLALKF

SEQ ID NO: 970 - protein, 19 aa, Artificial
  Short Peptide
FWKKLKKIPPKFLKLALKF

SEQ ID NO: 971 - protein, 18 aa, Artificial
  Short Peptide
KKKLFLKIPKFLKLALKF

SEQ ID NO: 972 - protein, 18 aa, Artificial
  Short Peptide
RKKLFLKIPKFLKLALKF

SEQ ID NO: 973 - protein, 18 aa, Artificial
  Short Peptide
FKKLFLKIPKFLKLALKF

SEQ ID NO: 974 - protein, 18 aa, Artificial
  Short Peptide
KWKLFLKIPKFLKLALKF

SEQ ID NO: 975 - protein, 18 aa, Artificial
  Short Peptide
RWKLFLKIPKFLKLALKF

SEQ ID NO: 976 - protein, 18 aa, Artificial
  Short Peptide
FWKLFLKIPKFLKLALKF

SEQ ID NO: 977 - protein, 18 aa, Artificial
  Short Peptide
KKKKFLKIPKFLKLALKF

SEQ ID NO: 978 - protein, 18 aa, Artificial
  Short Peptide
RKKKFLKIPKFLKLALKF

SEQ ID NO: 979 - protein, 18 aa, Artificial
  Short Peptide
FKKKFLKIPKFLKLALKF

SEQ ID NO: 980 - protein, 18 aa, Artificial
  Short Peptide
KWKKFLKIPKFLKLALKF

SEQ ID NO: 981 - protein, 18 aa, Artificial
  Short Peptide
RWKKFLKIPKFLKLALKF

SEQ ID NO: 982 - protein, 18 aa, Artificial
  Short Peptide
FWKKFLKIPKFLKLALKF

SEQ ID NO: 983 - protein, 18 aa, Artificial
  Short Peptide
KKKLLLKIPKFLKLALKF

SEQ ID NO: 984 - protein, 18 aa, Artificial
  Short Peptide
RKKLLLKIPKFLKLALKF

SEQ ID NO: 985 - protein, 18 aa, Artificial
  Short Peptide
FKKLLLKIPKFLKLALKF

SEQ ID NO: 986 - protein, 18 aa, Artificial
  Short Peptide
KWKLLLKIPKFLKLALKF

SEQ ID NO: 987 - protein, 18 aa, Artificial
  Short Peptide
RWKLLLKIPKFLKLALKF

SEQ ID NO: 988 - protein, 18 aa, Artificial
  Short Peptide
FWKLLLKIPKFLKLALKF

SEQ ID NO: 989 - protein, 18 aa, Artificial
  Short Peptide
KKKKLLKIPKFLKLALKF

SEQ ID NO: 990 - protein, 18 aa, Artificial
  Short Peptide
RKKKLLKIPKFLKLALKF

SEQ ID NO: 991 - protein, 18 aa, Artificial
  Short Peptide
FKKKLLKIPKFLKLALKF

SEQ ID NO: 992 - protein, 18 aa, Artificial
  Short Peptide
KWKKLLKIPKFLKLALKF

SEQ ID NO: 993 - protein, 18 aa, Artificial
  Short Peptide
RWKKLLKIPKFLKLALKF

SEQ ID NO: 994 - protein, 18 aa, Artificial
  Short Peptide
FWKKLLKIPKFLKLALKF

SEQ ID NO: 995 - protein, 18 aa, Artificial
  Short Peptide
KKKLFKKIPKFLKLALKF

SEQ ID NO: 996 - protein, 18 aa, Artificial
  Short Peptide
RKKLFKKIPKFLKLALKF

SEQ ID NO: 997 - protein, 18 aa, Artificial
  Short Peptide
FKKLFKKIPKFLKLALKF

SEQ ID NO: 998 - protein, 18 aa, Artificial
  Short Peptide
KWKLFKKIPKFLKLALKF

SEQ ID NO: 999 - protein, 18 aa, Artificial
  Short Peptide
RWKLFKKIPKFLKLALKF

SEQ ID NO: 1000 - protein, 18 aa, Artificial
  Short Peptide
FWKLFKKIPKFLKLALKF

SEQ ID NO: 1001 - protein, 18 aa, Artificial
  Short Peptide
KKKKFKKIPKFLKLALKF

SEQ ID NO: 1002 - protein, 18 aa, Artificial
  Short Peptide
RKKKFKKIPKFLKLALKF

SEQ ID NO: 1003 - protein, 18 aa, Artificial
  Short Peptide
FKKKFKKIPKFLKLALKF

SEQ ID NO: 1004 - protein, 18 aa, Artificial
  Short Peptide
KWKKFKKIPKFLKLALKF

SEQ ID NO: 1005 - protein, 18 aa, Artificial
  Short Peptide
RWKKFKKIPKFLKLALKF

SEQ ID NO: 1006 - protein, 18 aa, Artificial
  Short Peptide
FWKKFKKIPKFLKLALKF

SEQ ID NO: 1007 - protein, 18 aa, Artificial
  Short Peptide
KKKLLKKIPKFLKLALKF

SEQ ID NO: 1008 - protein, 18 aa, Artificial
  Short Peptide
RKKLLKKIPKFLKLALKF

SEQ ID NO: 1009 - protein, 18 aa, Artificial
  Short Peptide
FKKLLKKIPKFLKLALKF

SEQ ID NO: 1010 - protein, 18 aa, Artificial
  Short Peptide
KWKLLKKIPKFLKLALKF

SEQ ID NO: 1011 - protein, 18 aa, Artificial
  Short Peptide
RWKLLKKIPKFLKLALKF

SEQ ID NO: 1012 - protein, 18 aa, Artificial
  Short Peptide
FWKLLKKIPKFLKLALKF

SEQ ID NO: 1013 - protein, 18 aa, Artificial
  Short Peptide
KKKKLKKIPKFLKLALKF

SEQ ID NO: 1014 - protein, 18 aa, Artificial
  Short Peptide
RKKKLKKIPKFLKLALKF

SEQ ID NO: 1015 - protein, 18 aa, Artificial
  Short Peptide
FKKKLKKIPKFLKLALKF

SEQ ID NO: 1016 - protein, 18 aa, Artificial
  Short Peptide
KWKKLKKIPKFLKLALKF

SEQ ID NO: 1017 - protein, 18 aa, Artificial
  Short Peptide
RWKKLKKIPKFLKLALKF

SEQ ID NO: 1018 - protein, 18 aa, Artificial
  Short Peptide
FWKKLKKIPKFLKLALKF

SEQ ID NO: 1019 - protein, 20 aa, Artificial
  Short Peptide
KKKLFLKIPPPKFKKLALKF

SEQ ID NO: 1020 - protein, 20 aa, Artificial
  Short Peptide
RKKLFLKIPPPKFKKLALKF

SEQ ID NO: 1021 - protein, 20 aa, Artificial
  Short Peptide
FKKLFLKIPPPKFKKLALKF

SEQ ID NO: 1022 - protein, 20 aa, Artificial
  Short Peptide
KWKLFLKIPPPKFKKLALKF

SEQ ID NO: 1023 - protein, 20 aa, Artificial
  Short Peptide
RWKLFLKIPPPKFKKLALKF

SEQ ID NO: 1024 - protein, 20 aa, Artificial
  Short Peptide
FWKLFLKIPPPKFKKLALKF

SEQ ID NO: 1025 - protein, 20 aa, Artificial
  Short Peptide
KKKKFLKIPPPKFKKLALKF

SEQ ID NO: 1026 - protein, 20 aa, Artificial
  Short Peptide
RKKKFLKIPPPKFKKLALKF

SEQ ID NO: 1027 - protein, 20 aa, Artificial
  Short Peptide
FKKKFLKIPPPKFKKLALKF

SEQ ID NO: 1028 - protein, 20 aa, Artificial
  Short Peptide
KWKKFLKIPPPKFKKLALKF

SEQ ID NO: 1029 - protein, 20 aa, Artificial
  Short Peptide
RWKKFLKIPPPKFKKLALKF

SEQ ID NO: 1030 - protein, 20 aa, Artificial
  Short Peptide
FWKKFLKIPPPKFKKLALKF

SEQ ID NO: 1031 - protein, 20 aa, Artificial
  Short Peptide
KKKLLLKIPPPKFKKLALKF

SEQ ID NO: 1032 - protein, 20 aa, Artificial
  Short Peptide
RKKLLLKIPPPKFKKLALKF

SEQ ID NO: 1033 - protein, 20 aa, Artificial
  Short Peptide
FKKLLLKIPPPKFKKLALKF

SEQ ID NO: 1034 - protein, 20 aa, Artificial
  Short Peptide
KWKLLLKIPPPKFKKLALKF

SEQ ID NO: 1035 - protein, 20 aa, Artificial
  Short Peptide
RWKLLLKIPPPKFKKLALKF

SEQ ID NO: 1036 - protein, 20 aa, Artificial
  Short Peptide
FWKLLLKIPPPKFKKLALKF

SEQ ID NO: 1037 - protein, 20 aa, Artificial
  Short Peptide
KKKKLLKIPPPKFKKLALKF

SEQ ID NO: 1038 - protein, 20 aa, Artificial
  Short Peptide
RKKKLLKIPPPKFKKLALKF

SEQ ID NO: 1039 - protein, 20 aa, Artificial
  Short Peptide
FKKKLLKIPPPKFKKLALKF

SEQ ID NO: 1040 - protein, 20 aa, Artificial
  Short Peptide
KWKKLLKIPPPKFKKLALKF

SEQ ID NO: 1041 - protein, 20 aa, Artificial
  Short Peptide
RWKKLLKIPPPKFKKLALKF

SEQ ID NO: 1042 - protein, 20 aa, Artificial
  Short Peptide
FWKKLLKIPPPKFKKLALKF

SEQ ID NO: 1043 - protein, 20 aa, Artificial
  Short Peptide
KKKLFKKIPPPKFKKLALKF

SEQ ID NO: 1044 - protein, 20 aa, Artificial
  Short Peptide
RKKLFKKIPPPKFKKLALKF

SEQ ID NO: 1045 - protein, 20 aa, Artificial
  Short Peptide
FKKLFKKIPPPKFKKLALKF

SEQ ID NO: 1046 - protein, 20 aa, Artificial
  Short Peptide
KWKLFKKIPPPKFKKLALKF

SEQ ID NO: 1047 - protein, 20 aa, Artificial
  Short Peptide
RWKLFKKIPPPKFKKLALKF

SEQ ID NO: 1048 - protein, 20 aa, Artificial
  Short Peptide
FWKLFKKIPPPKFKKLALKF

SEQ ID NO: 1049 - protein, 20 aa, Artificial
  Short Peptide
KKKKFKKIPPPKFKKLALKF

SEQ ID NO: 1050 - protein, 20 aa, Artificial
  Short Peptide
RKKKFKKIPPPKFKKLALKF

SEQ ID NO: 1051 - protein, 20 aa, Artificial
  Short Peptide
FKKKFKKIPPPKFKKLALKF

SEQ ID NO: 1052 - protein, 20 aa, Artificial
  Short Peptide
KWKKFKKIPPPKFKKLALKF

SEQ ID NO: 1053 - protein, 20 aa, Artificial
  Short Peptide
RWKKFKKIPPPKFKKLALKF

SEQ ID NO: 1054 - protein, 20 aa, Artificial
  Short Peptide
FWKKFKKIPPPKFKKLALKF

SEQ ID NO: 1055 - protein, 20 aa, Artificial
  Short Peptide
KKKLLKKIPPPKFKKLALKF

SEQ ID NO: 1056 - protein, 20 aa, Artificial
  Short Peptide
RKKLLKKIPPPKFKKLALKF

SEQ ID NO: 1057 - protein, 20 aa, Artificial
  Short Peptide
FKKLLKKIPPPKFKKLALKF

SEQ ID NO: 1058 - protein, 20 aa, Artificial
  Short Peptide
KWKLLKKIPPPKFKKLALKF

SEQ ID NO: 1059 - protein, 20 aa, Artificial
  Short Peptide
RWKLLKKIPPPKFKKLALKF

SEQ ID NO: 1060 - protein, 20 aa, Artificial
  Short Peptide
FWKLLKKIPPPKFKKLALKF

SEQ ID NO: 1061 - protein, 20 aa, Artificial
  Short Peptide
KKKKLKKIPPPKFKKLALKF

SEQ ID NO: 1062 - protein, 20 aa, Artificial
  Short Peptide
RKKKLKKIPPPKFKKLALKF

SEQ ID NO: 1063 - protein, 20 aa, Artificial
  Short Peptide
FKKKLKKIPPPKFKKLALKF

SEQ ID NO: 1064 - protein, 20 aa, Artificial
  Short Peptide
KWKKLKKIPPPKFKKLALKF

SEQ ID NO: 1065 - protein, 20 aa, Artificial
  Short Peptide
RWKKLKKIPPPKFKKLALKF

SEQ ID NO: 1066 - protein, 20 aa, Artificial
  Short Peptide
FWKKLKKIPPPKFKKLALKF

SEQ ID NO: 1067 - protein, 19 aa, Artificial
  Short Peptide
KKKLFLKIPPKFKKLALKF

SEQ ID NO: 1068 - protein, 19 aa, Artificial
  Short Peptide
RKKLFLKIPPKFKKLALKF

SEQ ID NO: 1069 - protein, 19 aa, Artificial
  Short Peptide
FKKLFLKIPPKFKKLALKF

SEQ ID NO: 1070 - protein, 19 aa, Artificial
  Short Peptide
KWKLFLKIPPKFKKLALKF

SEQ ID NO: 1071 - protein, 19 aa, Artificial
  Short Peptide
RWKLFLKIPPKFKKLALKF

SEQ ID NO: 1072 - protein, 19 aa, Artificial
  Short Peptide
FWKLFLKIPPKFKKLALKF

SEQ ID NO: 1073 - protein, 19 aa, Artificial
  Short Peptide
KKKKFLKIPPKFKKLALKF

SEQ ID NO: 1074 - protein, 19 aa, Artificial
  Short Peptide
RKKKFLKIPPKFKKLALKF

SEQ ID NO: 1075 - protein, 19 aa, Artificial
  Short Peptide
FKKKFLKIPPKFKKLALKF

SEQ ID NO: 1076 - protein, 19 aa, Artificial
  Short Peptide
KWKKFLKIPPKFKKLALKF

SEQ ID NO: 1077 - protein, 19 aa, Artificial
  Short Peptide
RWKKFLKIPPKFKKLALKF

SEQ ID NO: 1078 - protein, 19 aa, Artificial
  Short Peptide
FWKKFLKIPPKFKKLALKF

SEQ ID NO: 1079 - protein, 19 aa, Artificial
  Short Peptide
KKKLLLKIPPKFKKLALKF

SEQ ID NO: 1080 - protein, 19 aa, Artificial
  Short Peptide
RKKLLLKIPPKFKKLALKF

SEQ ID NO: 1081 - protein, 19 aa, Artificial
  Short Peptide
FKKLLLKIPPKFKKLALKF

SEQ ID NO: 1082 - protein, 19 aa, Artificial
  Short Peptide
KWKLLLKIPPKFKKLALKF

SEQ ID NO: 1083 - protein, 19 aa, Artificial
  Short Peptide
RWKLLLKIPPKFKKLALKF

SEQ ID NO: 1084 - protein, 19 aa, Artificial
  Short Peptide
FWKLLLKIPPKFKKLALKF

SEQ ID NO: 1085 - protein, 19 aa, Artificial
  Short Peptide
KKKKLLKIPPKFKKLALKF

SEQ ID NO: 1086 - protein, 19 aa, Artificial
  Short Peptide
RKKKLLKIPPKFKKLALKF

SEQ ID NO: 1087 - protein, 19 aa, Artificial
  Short Peptide
FKKKLLKIPPKFKKLALKF

SEQ ID NO: 1088 - protein, 19 aa, Artificial
  Short Peptide
KWKKLLKIPPKFKKLALKF

SEQ ID NO: 1089 - protein, 19 aa, Artificial
  Short Peptide
RWKKLLKIPPKFKKLALKF

SEQ ID NO: 1090 - protein, 19 aa, Artificial
  Short Peptide
FWKKLLKIPPKFKKLALKF

SEQ ID NO: 1091 - protein, 19 aa, Artificial
  Short Peptide
KKKLFKKIPPKFKKLALKF

SEQ ID NO: 1092 - protein, 19 aa, Artificial
  Short Peptide
RKKLFKKIPPKFKKLALKF

SEQ ID NO: 1093 - protein, 19 aa, Artificial
  Short Peptide
FKKLFKKIPPKFKKLALKF

SEQ ID NO: 1094 - protein, 19 aa, Artificial
  Short Peptide
KWKLFKKIPPKFKKLALKF

SEQ ID NO: 1095 - protein, 19 aa, Artificial
  Short Peptide
RWKLFKKIPPKFKKLALKF

SEQ ID NO: 1096 - protein, 19 aa, Artificial
  Short Peptide
FWKLFKKIPPKFKKLALKF

SEQ ID NO: 1097 - protein, 19 aa, Artificial
  Short Peptide
KKKKFKKIPPKFKKLALKF

SEQ ID NO: 1098 - protein, 19 aa, Artificial
  Short Peptide
RKKKFKKIPPKFKKLALKF

SEQ ID NO: 1099 - protein, 19 aa, Artificial
  Short Peptide
FKKKFKKIPPKFKKLALKF

SEQ ID NO: 1100 - protein, 19 aa, Artificial
  Short Peptide
KWKKFKKIPPKFKKLALKF

SEQ ID NO: 1101 - protein, 19 aa, Artificial
  Short Peptide
RWKKFKKIPPKFKKLALKF

SEQ ID NO: 1102 - protein, 19 aa, Artificial
  Short Peptide
FWKKFKKIPPKFKKLALKF

SEQ ID NO: 1103 - protein, 19 aa, Artificial
  Short Peptide
KKKLLKKIPPKFKKLALKF

SEQ ID NO: 1104 - protein, 19 aa, Artificial
  Short Peptide
RKKLLKKIPPKFKKLALKF

SEQ ID NO: 1105 - protein, 19 aa, Artificial
  Short Peptide
FKKLLKKIPPKFKKLALKF

SEQ ID NO: 1106 - protein, 19 aa, Artificial
  Short Peptide
KWKLLKKIPPKFKKLALKF

SEQ ID NO: 1107 - protein, 19 aa, Artificial
  Short Peptide
RWKLLKKIPPKFKKLALKF

SEQ ID NO: 1108 - protein, 19 aa, Artificial
  Short Peptide
FWKLLKKIPPKFKKLALKF

SEQ ID NO: 1109 - protein, 19 aa, Artificial
  Short Peptide
KKKKLKKIPPKFKKLALKF

SEQ ID NO: 1110 - protein, 19 aa, Artificial
  Short Peptide
RKKKLKKIPPKFKKLALKF

SEQ ID NO: 1111 - protein, 19 aa, Artificial
  Short Peptide
FKKKLKKIPPKFKKLALKF

SEQ ID NO: 1112 - protein, 19 aa, Artificial
  Short Peptide
KWKKLKKIPPKFKKLALKF

SEQ ID NO: 1113 - protein, 19 aa, Artificial
  Short Peptide
RWKKLKKIPPKFKKLALKF

SEQ ID NO: 1114 - protein, 19 aa, Artificial
  Short Peptide
FWKKLKKIPPKFKKLALKF

SEQ ID NO: 1115 - protein, 18 aa, Artificial
  Short Peptide
KKKLFLKIPKFKKLALKF

SEQ ID NO: 1116 - protein, 18 aa, Artificial
  Short Peptide
RKKLFLKIPKFKKLALKF

SEQ ID NO: 1117 - protein, 18 aa, Artificial
  Short Peptide
FKKLFLKIPKFKKLALKF

SEQ ID NO: 1118 - protein, 18 aa, Artificial
  Short Peptide
KWKLFLKIPKFKKLALKF

SEQ ID NO: 1119 - protein, 18 aa, Artificial
  Short Peptide
RWKLFLKIPKFKKLALKF

SEQ ID NO: 1120 - protein, 18 aa, Artificial
  Short Peptide
FWKLFLKIPKFKKLALKF

SEQ ID NO: 1121 - protein, 18 aa, Artificial
  Short Peptide
KKKKFLKIPKFKKLALKF

SEQ ID NO: 1122 - protein, 18 aa, Artificial
  Short Peptide
RKKKFLKIPKFKKLALKF

SEQ ID NO: 1123 - protein, 18 aa, Artificial
  Short Peptide
FKKKFLKIPKFKKLALKF

SEQ ID NO: 1124 - protein, 18 aa, Artificial
  Short Peptide
KWKKFLKIPKFKKLALKF

SEQ ID NO: 1125 - protein, 18 aa, Artificial
  Short Peptide
RWKKFLKIPKFKKLALKF

SEQ ID NO: 1126 - protein, 18 aa, Artificial
  Short Peptide
FWKKFLKIPKFKKLALKF

SEQ ID NO: 1127 - protein, 18 aa, Artificial
  Short Peptide
KKKLLLKIPKFKKLALKF

SEQ ID NO: 1128 - protein, 18 aa, Artificial
  Short Peptide
RKKLLLKIPKFKKLALKF

SEQ ID NO: 1129 - protein, 18 aa, Artificial
  Short Peptide
FKKLLLKIPKFKKLALKF

SEQ ID NO: 1130 - protein, 18 aa, Artificial
  Short Peptide
KWKLLLKIPKFKKLALKF

SEQ ID NO: 1131 - protein, 18 aa, Artificial
  Short Peptide
RWKLLLKIPKFKKLALKF

SEQ ID NO: 1132 - protein, 18 aa, Artificial
  Short Peptide
FWKLLLKIPKFKKLALKF

SEQ ID NO: 1133 - protein, 18 aa, Artificial
  Short Peptide
KKKKLLKIPKFKKLALKF

SEQ ID NO: 1134 - protein, 18 aa, Artificial
  Short Peptide
RKKKLLKIPKFKKLALKF

SEQ ID NO: 1135 - protein, 18 aa, Artificial
  Short Peptide
FKKKLLKIPKFKKLALKF

SEQ ID NO: 1136 - protein, 18 aa, Artificial
  Short Peptide
KWKKLLKIPKFKKLALKF

SEQ ID NO: 1137 - protein, 18 aa, Artificial
  Short Peptide
RWKKLLKIPKFKKLALKF

SEQ ID NO: 1138 - protein, 18 aa, Artificial
  Short Peptide
FWKKLLKIPKFKKLALKF

SEQ ID NO: 1139 - protein, 18 aa, Artificial
  Short Peptide
KKKLFKKIPKFKKLALKF

SEQ ID NO: 1140 - protein, 18 aa, Artificial
  Short Peptide
RKKLFKKIPKFKKLALKF

SEQ ID NO: 1141 - protein, 18 aa, Artificial
  Short Peptide
FKKLFKKIPKFKKLALKF

SEQ ID NO: 1142 - protein, 18 aa, Artificial
  Short Peptide
KWKLFKKIPKFKKLALKF

SEQ ID NO: 1143 - protein, 18 aa, Artificial
  Short Peptide
RWKLFKKIPKFKKLALKF

SEQ ID NO: 1144 - protein, 18 aa, Artificial
  Short Peptide
FWKLFKKIPKFKKLALKF

SEQ ID NO: 1145 - protein, 18 aa, Artificial
  Short Peptide
KKKKFKKIPKFKKLALKF

SEQ ID NO: 1146 - protein, 18 aa, Artificial
  Short Peptide
RKKKFKKIPKFKKLALKF

SEQ ID NO: 1147 - protein, 18 aa, Artificial
  Short Peptide
FKKKFKKIPKFKKLALKF

SEQ ID NO: 1148 - protein, 18 aa, Artificial
  Short Peptide
KWKKFKKIPKFKKLALKF

SEQ ID NO: 1149 - protein, 18 aa, Artificial
  Short Peptide
RWKKFKKIPKFKKLALKF

SEQ ID NO: 1150 - protein, 18 aa, Artificial
  Short Peptide
FWKKFKKIPKFKKLALKF

SEQ ID NO: 1151 - protein, 18 aa, Artificial
  Short Peptide
KKKLLKKIPKFKKLALKF

SEQ ID NO: 1152 - protein, 18 aa, Artificial
  Short Peptide
RKKLLKKIPKFKKLALKF

SEQ ID NO: 1153 - protein, 18 aa, Artificial
  Short Peptide
FKKLLKKIPKFKKLALKF

SEQ ID NO: 1154 - protein, 18 aa, Artificial
  Short Peptide
RWKLLKKIPKFKKLALKF

SEQ ID NO: 1155 - protein, 18 aa, Artificial
  Short Peptide
FWKLLKKIPKFKKLALKF

SEQ ID NO: 1156 - protein, 18 aa, Artificial
  Short Peptide
KKKKLKKIPKFKKLALKF

SEQ ID NO: 1157 - protein, 18 aa, Artificial
  Short Peptide
RKKKLKKIPKFKKLALKF

SEQ ID NO: 1158 - protein, 18 aa, Artificial
  Short Peptide
FKKKLKKIPKFKKLALKF

SEQ ID NO: 1159 - protein, 18 aa, Artificial
  Short Peptide
KWKKLKKIPKFKKLALKF

SEQ ID NO: 1160 - protein, 18 aa, Artificial
  Short Peptide
RWKKLKKIPKFKKLALKF

SEQ ID NO: 1161 - protein, 18 aa, Artificial
  Short Peptide
FWKKLKKIPKFKKLALKF

SEQ ID NO: 1162 - protein, 20 aa, Artificial
  Short Peptide
KKKLFLKIPPPKFLHVALKF

SEQ ID NO: 1163 - protein, 20 aa, Artificial
  Short Peptide
RKKLFLKIPPPKFLHVALKF

SEQ ID NO: 1164 - protein, 20 aa, Artificial
  Short Peptide
FKKLFLKIPPPKFLHVALKF

SEQ ID NO: 1165 - protein, 20 aa, Artificial
  Short Peptide
KWKLFLKIPPPKFLHVALKF

SEQ ID NO: 1166 - protein, 20 aa, Artificial
  Short Peptide
RWKLFLKIPPPKFLHVALKF

SEQ ID NO: 1167 - protein, 20 aa, Artificial
  Short Peptide
FWKLFLKIPPPKFLHVALKF

SEQ ID NO: 1168 - protein, 20 aa, Artificial
  Short Peptide
KKKKFLKIPPPKFLHVALKF

SEQ ID NO: 1169 - protein, 20 aa, Artificial
  Short Peptide
RKKKFLKIPPPKFLHVALKF

SEQ ID NO: 1170 - protein, 20 aa, Artificial
  Short Peptide
FKKKFLKIPPPKFLHVALKF

SEQ ID NO: 1171 - protein, 20 aa, Artificial
  Short Peptide
KWKKFLKIPPPKFLHVALKF

SEQ ID NO: 1172 - protein, 20 aa, Artificial
  Short Peptide
RWKKFLKIPPPKFLHVALKF

SEQ ID NO: 1173 - protein, 20 aa, Artificial
  Short Peptide
FWKKFLKIPPPKFLHVALKF

SEQ ID NO: 1174 - protein, 20 aa, Artificial
  Short Peptide
KKKLLLKIPPPKFLHVALKF

SEQ ID NO: 1175 - protein, 20 aa, Artificial
  Short Peptide
RKKLLLKIPPPKFLHVALKF

SEQ ID NO: 1176 - protein, 20 aa, Artificial
  Short Peptide
FKKLLLKIPPPKFLHVALKF

SEQ ID NO: 1177 - protein, 20 aa, Artificial
  Short Peptide
KWKLLLKIPPPKFLHVALKF

SEQ ID NO: 1178 - protein, 20 aa, Artificial
  Short Peptide
RWKLLLKIPPPKFLHVALKF

SEQ ID NO: 1179 - protein, 20 aa, Artificial
  Short Peptide
FWKLLLKIPPPKFLHVALKF

SEQ ID NO: 1180 - protein, 20 aa, Artificial
  Short Peptide
KKKKLLKIPPPKFLHVALKF

SEQ ID NO: 1181 - protein, 20 aa, Artificial
  Short Peptide
RKKKLLKIPPPKFLHVALKF

SEQ ID NO: 1182 - protein, 20 aa, Artificial
  Short Peptide
FKKKLLKIPPPKFLHVALKF

SEQ ID NO: 1183 - protein, 20 aa, Artificial
  Short Peptide
KWKKLLKIPPPKFLHVALKF

SEQ ID NO: 1184 - protein, 20 aa, Artificial
  Short Peptide
RWKKLLKIPPPKFLHVALKF

SEQ ID NO: 1185 - protein, 20 aa, Artificial
  Short Peptide
FWKKLLKIPPPKFLHVALKF

SEQ ID NO: 1186 - protein, 20 aa, Artificial
  Short Peptide
KKKLFKKIPPPKFLHVALKF

SEQ ID NO: 1187 - protein, 20 aa, Artificial
  Short Peptide
RKKLFKKIPPPKFLHVALKF

SEQ ID NO: 1188 - protein, 20 aa, Artificial
  Short Peptide
FKKLFKKIPPPKFLHVALKF

SEQ ID NO: 1189 - protein, 20 aa, Artificial
  Short Peptide
KWKLFKKIPPPKFLHVALKF

SEQ ID NO: 1190 - protein, 20 aa, Artificial
  Short Peptide
RWKLFKKIPPPKFLHVALKF

SEQ ID NO: 1191 - protein, 20 aa, Artificial
  Short Peptide
FWKLFKKIPPPKFLHVALKF

SEQ ID NO: 1192 - protein, 20 aa, Artificial
  Short Peptide
KKKKFKKIPPPKFLHVALKF

SEQ ID NO: 1193 - protein, 20 aa, Artificial
  Short Peptide
RKKKFKKIPPPKFLHVALKF

SEQ ID NO: 1194 - protein, 20 aa, Artificial
  Short Peptide
FKKKFKKIPPPKFLHVALKF

SEQ ID NO: 1195 - protein, 20 aa, Artificial
  Short Peptide
KWKKFKKIPPPKFLHVALKF

SEQ ID NO: 1196 - protein, 20 aa, Artificial
  Short Peptide
RWKKFKKIPPPKFLHVALKF

SEQ ID NO: 1197 - protein, 20 aa, Artificial
  Short Peptide
FWKKFKKIPPPKFLHVALKF

SEQ ID NO: 1198 - protein, 20 aa, Artificial
  Short Peptide
KKKLLKKIPPPKFLHVALKF

SEQ ID NO: 1199 - protein, 20 aa, Artificial
  Short Peptide
RKKLLKKIPPPKFLHVALKF

SEQ ID NO: 1200 - protein, 20 aa, Artificial
  Short Peptide
FKKLLKKIPPPKFLHVALKF

SEQ ID NO: 1201 - protein, 20 aa, Artificial
  Short Peptide
KWKLLKKIPPPKFLHVALKF

SEQ ID NO: 1202 - protein, 20 aa, Artificial
  Short Peptide
RWKLLKKIPPPKFLHVALKF

SEQ ID NO: 1203 - protein, 20 aa, Artificial
  Short Peptide
FWKLLKKIPPPKFLHVALKF

SEQ ID NO: 1204 - protein, 20 aa, Artificial
  Short Peptide
KKKKLKKIPPPKFLHVALKF

SEQ ID NO: 1205 - protein, 20 aa, Artificial
  Short Peptide
RKKKLKKIPPPKFLHVALKF

SEQ ID NO: 1206 - protein, 20 aa, Artificial
  Short Peptide
FKKKLKKIPPPKFLHVALKF

SEQ ID NO: 1207 - protein, 20 aa, Artificial
  Short Peptide
KWKKLKKIPPPKFLHVALKF

SEQ ID NO: 1208 - protein, 20 aa, Artificial
  Short Peptide
RWKKLKKIPPPKFLHVALKF

SEQ ID NO: 1209 - protein, 20 aa, Artificial
  Short Peptide
FWKKLKKIPPPKFLHVALKF

SEQ ID NO: 1210 - protein, 19 aa, Artificial
  Short Peptide
KKKLFLKIPPKFLHVALKF

SEQ ID NO: 1211 - protein, 19 aa, Artificial
  Short Peptide
RKKLFLKIPPKFLHVALKF

SEQ ID NO: 1212 - protein, 19 aa, Artificial
  Short Peptide
FKKLFLKIPPKFLHVALKF

SEQ ID NO: 1213 - protein, 19 aa, Artificial
  Short Peptide
KWKLFLKIPPKFLHVALKF

SEQ ID NO: 1214 - protein, 19 aa, Artificial
  Short Peptide
RWKLFLKIPPKFLHVALKF

SEQ ID NO: 1215 - protein, 19 aa, Artificial
  Short Peptide
FWKLFLKIPPKFLHVALKF

SEQ ID NO: 1216 - protein, 19 aa, Artificial
  Short Peptide
KKKKFLKIPPKFLHVALKF

SEQ ID NO: 1217 - protein, 19 aa, Artificial
  Short Peptide
RKKKFLKIPPKFLHVALKF

SEQ ID NO: 1218 - protein, 19 aa, Artificial
  Short Peptide
FKKKFLKIPPKFLHVALKF

SEQ ID NO: 1219 - protein, 19 aa, Artificial
  Short Peptide
KWKKFLKIPPKFLHVALKF

SEQ ID NO: 1220 - protein, 19 aa, Artificial
  Short Peptide
RWKKFLKIPPKFLHVALKF

SEQ ID NO: 1221 - protein, 19 aa, Artificial
  Short Peptide
FWKKFLKIPPKFLHVALKF

SEQ ID NO: 1222 - protein, 19 aa, Artificial
  Short Peptide
KKKLLLKIPPKFLHVALKF

SEQ ID NO: 1223 - protein, 19 aa, Artificial
  Short Peptide
RKKLLLKIPPKFLHVALKF

SEQ ID NO: 1224 - protein, 19 aa, Artificial
  Short Peptide
FKKLLLKIPPKFLHVALKF

SEQ ID NO: 1225 - protein, 19 aa, Artificial
  Short Peptide
KWKLLLKIPPKFLHVALKF

SEQ ID NO: 1226 - protein, 19 aa, Artificial
  Short Peptide
RWKLLLKIPPKFLHVALKF

SEQ ID NO: 1227 - protein, 19 aa, Artificial
  Short Peptide
FWKLLLKIPPKFLHVALKF

SEQ ID NO: 1228 - protein, 19 aa, Artificial
  Short Peptide
KKKKLLKIPPKFLHVALKF

SEQ ID NO: 1229 - protein, 19 aa, Artificial
  Short Peptide
RKKKLLKIPPKFLHVALKF

SEQ ID NO: 1230 - protein, 19 aa, Artificial
  Short Peptide
FKKKLLKIPPKFLHVALKF

SEQ ID NO: 1231 - protein, 19 aa, Artificial
  Short Peptide
KWKKLLKIPPKFLHVALKF

SEQ ID NO: 1232 - protein, 19 aa, Artificial
  Short Peptide
RWKKLLKIPPKFLHVALKF

SEQ ID NO: 1233 - protein, 19 aa, Artificial
  Short Peptide
FWKKLLKIPPKFLHVALKF

SEQ ID NO: 1234 - protein, 19 aa, Artificial
  Short Peptide
KKKLFKKIPPKFLHVALKF

SEQ ID NO: 1235 - protein, 19 aa, Artificial
  Short Peptide
RKKLFKKIPPKFLHVALKF

SEQ ID NO: 1236 - protein, 19 aa, Artificial
  Short Peptide
FKKLFKKIPPKFLHVALKF

SEQ ID NO: 1237 - protein, 19 aa, Artificial
  Short Peptide
KWKLFKKIPPKFLHVALKF

SEQ ID NO: 1238 - protein, 19 aa, Artificial
  Short Peptide
RWKLFKKIPPKFLHVALKF

SEQ ID NO: 1239 - protein, 19 aa, Artificial
  Short Peptide
FWKLFKKIPPKFLHVALKF

SEQ ID NO: 1240 - protein, 19 aa, Artificial
  Short Peptide
KKKKFKKIPPKFLHVALKF

SEQ ID NO: 1241 - protein, 19 aa, Artificial
  Short Peptide
RKKKFKKIPPKFLHVALKF

SEQ ID NO: 1242 - protein, 19 aa, Artificial
  Short Peptide
FKKKFKKIPPKFLHVALKF

SEQ ID NO: 1243 - protein, 19 aa, Artificial
  Short Peptide
KWKKFKKIPPKFLHVALKF

SEQ ID NO: 1244 - protein, 19 aa, Artificial
  Short Peptide
RWKKFKKIPPKFLHVALKF

SEQ ID NO: 1245 - protein, 19 aa, Artificial
  Short Peptide
FWKKFKKIPPKFLHVALKF

SEQ ID NO: 1246 - protein, 19 aa, Artificial
  Short Peptide
KKKLLKKIPPKFLHVALKF

SEQ ID NO: 1247 - protein, 19 aa, Artificial
  Short Peptide
RKKLLKKIPPKFLHVALKF

SEQ ID NO: 1248 - protein, 19 aa, Artificial
  Short Peptide
FKKLLKKIPPKFLHVALKF

SEQ ID NO: 1249 - protein, 19 aa, Artificial
  Short Peptide
KWKLLKKIPPKFLHVALKF

SEQ ID NO: 1250 - protein, 19 aa, Artificial
  Short Peptide
RWKLLKKIPPKFLHVALKF

SEQ ID NO: 1251 - protein, 19 aa, Artificial
  Short Peptide
FWKLLKKIPPKFLHVALKF

SEQ ID NO: 1252 - protein, 19 aa, Artificial
  Short Peptide
KKKKLKKIPPKFLHVALKF

SEQ ID NO: 1253 - protein, 19 aa, Artificial
  Short Peptide
RKKKLKKIPPKFLHVALKF

SEQ ID NO: 1254 - protein, 19 aa, Artificial
  Short Peptide
FKKKLKKIPPKFLHVALKF

SEQ ID NO: 1255 - protein, 19 aa, Artificial
  Short Peptide
KWKKLKKIPPKFLHVALKF

SEQ ID NO: 1256 - protein, 19 aa, Artificial
  Short Peptide
RWKKLKKIPPKFLHVALKF

SEQ ID NO: 1257 - protein, 19 aa, Artificial
  Short Peptide
FWKKLKKIPPKFLHVALKF

SEQ ID NO: 1258 - protein, 18 aa, Artificial
  Short Peptide
KKKLFLKIPKFLHVALKF

SEQ ID NO: 1259 - protein, 18 aa, Artificial
  Short Peptide
RKKLFLKIPKFLHVALKF

SEQ ID NO: 1260 - protein, 18 aa, Artificial
  Short Peptide
FKKLFLKIPKFLHVALKF

SEQ ID NO: 1261 - protein, 18 aa, Artificial
  Short Peptide
KWKLFLKIPKFLHVALKF

SEQ ID NO: 1262 - protein, 18 aa, Artificial
  Short Peptide
RWKLFLKIPKFLHVALKF

SEQ ID NO: 1263 - protein, 18 aa, Artificial
  Short Peptide
FWKLFLKIPKFLHVALKF

SEQ ID NO: 1264 - protein, 18 aa, Artificial
  Short Peptide
KKKKFLKIPKFLHVALKF

SEQ ID NO: 1265 - protein, 18 aa, Artificial
  Short Peptide
RKKKFLKIPKFLHVALKF

SEQ ID NO: 1266 - protein, 18 aa, Artificial
  Short Peptide
FKKKFLKIPKFLHVALKF

SEQ ID NO: 1267 - protein, 18 aa, Artificial
  Short Peptide
KWKKFLKIPKFLHVALKF

SEQ ID NO: 1268 - protein, 18 aa, Artificial
  Short Peptide
RWKKFLKIPKFLHVALKF

SEQ ID NO: 1269 - protein, 18 aa, Artificial
  Short Peptide
FWKKFLKIPKFLHVALKF

SEQ ID NO: 1270 - protein, 18 aa, Artificial
  Short Peptide
KKKLLLKIPKFLHVALKF

SEQ ID NO: 1271 - protein, 18 aa, Artificial
  Short Peptide
RKKLLLKIPKFLHVALKF

SEQ ID NO: 1272 - protein, 18 aa, Artificial
  Short Peptide
FKKLLLKIPKFLHVALKF

SEQ ID NO: 1273 - protein, 18 aa, Artificial
  Short Peptide
KWKLLLKIPKFLHVALKF

SEQ ID NO: 1274 - protein, 18 aa, Artificial
  Short Peptide
RWKLLLKIPKFLHVALKF

SEQ ID NO: 1275 - protein, 18 aa, Artificial
  Short Peptide
FWKLLLKIPKFLHVALKF

SEQ ID NO: 1276 - protein, 18 aa, Artificial
  Short Peptide
KKKKLLKIPKFLHVALKF

SEQ ID NO: 1277 - protein, 18 aa, Artificial
  Short Peptide
RKKKLLKIPKFLHVALKF

SEQ ID NO: 1278 - protein, 18 aa, Artificial
  Short Peptide
FKKKLLKIPKFLHVALKF

SEQ ID NO: 1279 - protein, 18 aa, Artificial
  Short Peptide
KWKKLLKIPKFLHVALKF

SEQ ID NO: 1280 - protein, 18 aa, Artificial
  Short Peptide
RWKKLLKIPKFLHVALKF

SEQ ID NO: 1281 - protein, 18 aa, Artificial
  Short Peptide
FWKKLLKIPKFLHVALKF

SEQ ID NO: 1282 - protein, 18 aa, Artificial
  Short Peptide
KKKLFKKIPKFLHVALKF

SEQ ID NO: 1283 - protein, 18 aa, Artificial
  Short Peptide
RKKLFKKIPKFLHVALKF

SEQ ID NO: 1284 - protein, 18 aa, Artificial
  Short Peptide
FKKLFKKIPKFLHVALKF

SEQ ID NO: 1285 - protein, 18 aa, Artificial
  Short Peptide
KWKLFKKIPKFLHVALKF

SEQ ID NO: 1286 - protein, 18 aa, Artificial
  Short Peptide
RWKLFKKIPKFLHVALKF

SEQ ID NO: 1287 - protein, 18 aa, Artificial
  Short Peptide
FWKLFKKIPKFLHVALKF

SEQ ID NO: 1288 - protein, 18 aa, Artificial
  Short Peptide
KKKKFKKIPKFLHVALKF

SEQ ID NO: 1289 - protein, 18 aa, Artificial
  Short Peptide
RKKKFKKIPKFLHVALKF

SEQ ID NO: 1290 - protein, 18 aa, Artificial
  Short Peptide
FKKKFKKIPKFLHVALKF

SEQ ID NO: 1291 - protein, 18 aa, Artificial
  Short Peptide
KWKKFKKIPKFLHVALKF

SEQ ID NO: 1292 - protein, 18 aa, Artificial
  Short Peptide
RWKKFKKIPKFLHVALKF

SEQ ID NO: 1293 - protein, 18 aa, Artificial
  Short Peptide
FWKKFKKIPKFLHVALKF

SEQ ID NO: 1294 - protein, 18 aa, Artificial
  Short Peptide
KKKLLKKIPKFLHVALKF

SEQ ID NO: 1295 - protein, 18 aa, Artificial
  Short Peptide
RKKLLKKIPKFLHVALKF

SEQ ID NO: 1296 - protein, 18 aa, Artificial
  Short Peptide
FKKLLKKIPKFLHVALKF

SEQ ID NO: 1297 - protein, 18 aa, Artificial
  Short Peptide
KWKLLKKIPKFLHVALKF

SEQ ID NO: 1298 - protein, 18 aa, Artificial
  Short Peptide
RWKLLKKIPKFLHVALKF

SEQ ID NO: 1299 - protein, 18 aa, Artificial
  Short Peptide
FWKLLKKIPKFLHVALKF

SEQ ID NO: 1300 - protein, 18 aa, Artificial
  Short Peptide
KKKKLKKIPKFLHVALKF

SEQ ID NO: 1301 - protein, 18 aa, Artificial
  Short Peptide
RKKKLKKIPKFLHVALKF

SEQ ID NO: 1302 - protein, 18 aa, Artificial
  Short Peptide
FKKKLKKIPKFLHVALKF

SEQ ID NO: 1303 - protein, 18 aa, Artificial
  Short Peptide
KWKKLKKIPKFLHVALKF

SEQ ID NO: 1304 - protein, 18 aa, Artificial
  Short Peptide
RWKKLKKIPKFLHVALKF

SEQ ID NO: 1305 - protein, 18 aa, Artificial
  Short Peptide
FWKKLKKIPKFLHVALKF

SEQ ID NO: 1306 - protein, 20 aa, Artificial
  Short Peptide
KKKLFLKIPPPKFKHVALKF

SEQ ID NO: 1307 - protein, 20 aa, Artificial
  Short Peptide
RKKLFLKIPPPKFKHVALKF

SEQ ID NO: 1308 - protein, 20 aa, Artificial
  Short Peptide
FKKLFLKIPPPKFKHVALKF

SEQ ID NO: 1309 - protein, 20 aa, Artificial
  Short Peptide
KWKLFLKIPPPKFKHVALKF

SEQ ID NO: 1310 - protein, 20 aa, Artificial
  Short Peptide
RWKLFLKIPPPKFKHVALKF

SEQ ID NO: 1311 - protein, 20 aa, Artificial
  Short Peptide
FWKLFLKIPPPKFKHVALKF

SEQ ID NO: 1312 - protein, 20 aa, Artificial
  Short Peptide
KKKKFLKIPPPKFKHVALKF

SEQ ID NO: 1313 - protein, 20 aa, Artificial
  Short Peptide
RKKKFLKIPPPKFKHVALKF

SEQ ID NO: 1314 - protein, 20 aa, Artificial
  Short Peptide
FKKKFLKIPPPKFKHVALKF

SEQ ID NO: 1315 - protein, 20 aa, Artificial
  Short Peptide
KWKKFLKIPPPKFKHVALKF

SEQ ID NO: 1316 - protein, 20 aa, Artificial
  Short Peptide
RWKKFLKIPPPKFKHVALKF

SEQ ID NO: 1317 - protein, 20 aa, Artificial
  Short Peptide
FWKKFLKIPPPKFKHVALKF

SEQ ID NO: 1318 - protein, 20 aa, Artificial
  Short Peptide
KKKLLLKIPPPKFKHVALKF

SEQ ID NO: 1319 - protein, 20 aa, Artificial
  Short Peptide
RKKLLLKIPPPKFKHVALKF

SEQ ID NO: 1320 - protein, 20 aa, Artificial
  Short Peptide
FKKLLLKIPPPKFKHVALKF

SEQ ID NO: 1321 - protein, 20 aa, Artificial
  Short Peptide
KWKLLLKIPPPKFKHVALKF

SEQ ID NO: 1322 - protein, 20 aa, Artificial
  Short Peptide
RWKLLLKIPPPKFKHVALKF

SEQ ID NO: 1323 - protein, 20 aa, Artificial
  Short Peptide
FWKLLLKIPPPKFKHVALKF

SEQ ID NO: 1324 - protein, 20 aa, Artificial
  Short Peptide
KKKKLLKIPPPKFKHVALKF

SEQ ID NO: 1325 - protein, 20 aa, Artificial
  Short Peptide
RKKKLLKIPPPKFKHVALKF

SEQ ID NO: 1326 - protein, 20 aa, Artificial
  Short Peptide
FKKKLLKIPPPKFKHVALKF

SEQ ID NO: 1327 - protein, 20 aa, Artificial
  Short Peptide
KWKKLLKIPPPKFKHVALKF

SEQ ID NO: 1328 - protein, 20 aa, Artificial
  Short Peptide
RWKKLLKIPPPKFKHVALKF

SEQ ID NO: 1329 - protein, 20 aa, Artificial
  Short Peptide
FWKKLLKIPPPKFKHVALKF

SEQ ID NO: 1330 - protein, 20 aa, Artificial
  Short Peptide
KKKLFKKIPPPKFKHVALKF

SEQ ID NO: 1331 - protein, 20 aa, Artificial
  Short Peptide
RKKLFKKIPPPKFKHVALKF

SEQ ID NO: 1332 - protein, 20 aa, Artificial
  Short Peptide
FKKLFKKIPPPKFKHVALKF

SEQ ID NO: 1333 - protein, 20 aa, Artificial
  Short Peptide
KWKLFKKIPPPKFKHVALKF

SEQ ID NO: 1334 - protein, 20 aa, Artificial
  Short Peptide
RWKLFKKIPPPKFKHVALKF

SEQ ID NO: 1335 - protein, 20 aa, Artificial
  Short Peptide
FWKLFKKIPPPKFKHVALKF

SEQ ID NO: 1336 - protein, 20 aa, Artificial
  Short Peptide
KKKKFKKIPPPKFKHVALKF

SEQ ID NO: 1337 - protein, 20 aa, Artificial
  Short Peptide
RKKKFKKIPPPKFKHVALKF

SEQ ID NO: 1338 - protein, 20 aa, Artificial
  Short Peptide
FKKKFKKIPPPKFKHVALKF

SEQ ID NO: 1339 - protein, 20 aa, Artificial
  Short Peptide
KWKKFKKIPPPKFKHVALKF

SEQ ID NO: 1340 - protein, 20 aa, Artificial
  Short Peptide
RWKKFKKIPPPKFKHVALKF

SEQ ID NO: 1341 - protein, 20 aa, Artificial
  Short Peptide
FWKKFKKIPPPKFKHVALKF

SEQ ID NO: 1342 - protein, 20 aa, Artificial
  Short Peptide
KKKLLKKIPPPKFKHVALKF

SEQ ID NO: 1343 - protein, 20 aa, Artificial
  Short Peptide
RKKLLKKIPPPKFKHVALKF

SEQ ID NO: 1344 - protein, 20 aa, Artificial
  Short Peptide
FKKLLKKIPPPKFKHVALKF

SEQ ID NO: 1345 - protein, 20 aa, Artificial
  Short Peptide
KWKLLKKIPPPKFKHVALKF

SEQ ID NO: 1346 - protein, 20 aa, Artificial
  Short Peptide
RWKLLKKIPPPKFKHVALKF

SEQ ID NO: 1347 - protein, 20 aa, Artificial
  Short Peptide
FWKLLKKIPPPKFKHVALKF

SEQ ID NO: 1348 - protein, 20 aa, Artificial
  Short Peptide
KKKKLKKIPPPKFKHVALKF

SEQ ID NO: 1349 - protein, 20 aa, Artificial
  Short Peptide
RKKKLKKIPPPKFKHVALKF

SEQ ID NO: 1350 - protein, 20 aa, Artificial
  Short Peptide
FKKKLKKIPPPKFKHVALKF

SEQ ID NO: 1351 - protein, 20 aa, Artificial
  Short Peptide
KWKKLKKIPPPKFKHVALKF

SEQ ID NO: 1352 - protein, 20 aa, Artificial
  Short Peptide
RWKKLKKIPPPKFKHVALKF

SEQ ID NO: 1353 - protein, 20 aa, Artificial
  Short Peptide
FWKKLKKIPPPKFKHVALKF

SEQ ID NO: 1354 - protein, 19 aa, Artificial
  Short Peptide
KKKLFLKIPPKFKHVALKF

SEQ ID NO: 1355 - protein, 19 aa, Artificial
  Short Peptide
RKKLFLKIPPKFKHVALKF

SEQ ID NO: 1356 - protein, 19 aa, Artificial
  Short Peptide
FKKLFLKIPPKFKHVALKF

SEQ ID NO: 1357 - protein, 19 aa, Artificial
  Short Peptide
KWKLFLKIPPKFKHVALKF

SEQ ID NO: 1358 - protein, 19 aa, Artificial
  Short Peptide
RWKLFLKIPPKFKHVALKF

SEQ ID NO: 1359 - protein, 19 aa, Artificial
  Short Peptide
FWKLFLKIPPKFKHVALKF

SEQ ID NO: 1360 - protein, 19 aa, Artificial
  Short Peptide
KKKKFLKIPPKFKHVALKF

SEQ ID NO: 1361 - protein, 19 aa, Artificial
  Short Peptide
RKKKFLKIPPKFKHVALKF

SEQ ID NO: 1362 - protein, 19 aa, Artificial
  Short Peptide
FKKKFLKIPPKFKHVALKF

SEQ ID NO: 1363 - protein, 19 aa, Artificial
  Short Peptide
KWKKFLKIPPKFKHVALKF

SEQ ID NO: 1364 - protein, 19 aa, Artificial
  Short Peptide
RWKKFLKIPPKFKHVALKF

SEQ ID NO: 1365 - protein, 19 aa, Artificial
  Short Peptide
FWKKFLKIPPKFKHVALKF

SEQ ID NO: 1366 - protein, 19 aa, Artificial
  Short Peptide
KKKLLLKIPPKFKHVALKF

SEQ ID NO: 1367 - protein, 19 aa, Artificial
  Short Peptide
RKKLLLKIPPKFKHVALKF

SEQ ID NO: 1368 - protein, 19 aa, Artificial
  Short Peptide
FKKLLLKIPPKFKHVALKF

SEQ ID NO: 1369 - protein, 19 aa, Artificial
  Short Peptide
KWKLLLKIPPKFKHVALKF

SEQ ID NO: 1370 - protein, 19 aa, Artificial
  Short Peptide
RWKLLLKIPPKFKHVALKF

SEQ ID NO: 1371 - protein, 19 aa, Artificial
  Short Peptide
FWKLLLKIPPKFKHVALKF

SEQ ID NO: 1372 - protein, 19 aa, Artificial
  Short Peptide
KKKKLLKIPPKFKHVALKF

SEQ ID NO: 1373 - protein, 19 aa, Artificial
  Short Peptide
RKKKLLKIPPKFKHVALKF

SEQ ID NO: 1374 - protein, 19 aa, Artificial
  Short Peptide
FKKKLLKIPPKFKHVALKF

SEQ ID NO: 1375 - protein, 19 aa, Artificial
  Short Peptide
KWKKLLKIPPKFKHVALKF

SEQ ID NO: 1376 - protein, 19 aa, Artificial
  Short Peptide
RWKKLLKIPPKFKHVALKF

SEQ ID NO: 1377 - protein, 19 aa, Artificial
  Short Peptide
FWKKLLKIPPKFKHVALKF

SEQ ID NO: 1378 - protein, 19 aa, Artificial
  Short Peptide
KKKLFKKIPPKFKHVALKF

SEQ ID NO: 1379 - protein, 19 aa, Artificial
  Short Peptide
RKKLFKKIPPKFKHVALKF

SEQ ID NO: 1380 - protein, 19 aa, Artificial
  Short Peptide
FKKLFKKIPPKFKHVALKF

SEQ ID NO: 1381 - protein, 19 aa, Artificial
  Short Peptide
KWKLFKKIPPKFKHVALKF

SEQ ID NO: 1382 - protein, 19 aa, Artificial
  Short Peptide
RWKLFKKIPPKFKHVALKF

SEQ ID NO: 1383 - protein, 19 aa, Artificial
  Short Peptide
FWKLFKKIPPKFKHVALKF

SEQ ID NO: 1384 - protein, 19 aa, Artificial
  Short Peptide
KKKKFKKIPPKFKHVALKF

SEQ ID NO: 1385 - protein, 19 aa, Artificial
  Short Peptide
RKKKFKKIPPKFKHVALKF

SEQ ID NO: 1386 - protein, 19 aa, Artificial
  Short Peptide
FKKKFKKIPPKFKHVALKF

SEQ ID NO: 1387 - protein, 19 aa, Artificial
  Short Peptide
KWKKFKKIPPKFKHVALKF

SEQ ID NO: 1388 - protein, 19 aa, Artificial
  Short Peptide
RWKKFKKIPPKFKHVALKF

SEQ ID NO: 1389 - protein, 19 aa, Artificial
  Short Peptide
FWKKFKKIPPKFKHVALKF

SEQ ID NO: 1390 - protein, 19 aa, Artificial
  Short Peptide
KKKLLKKIPPKFKHVALKF

SEQ ID NO: 1391 - protein, 19 aa, Artificial
  Short Peptide
RKKLLKKIPPKFKHVALKF

SEQ ID NO: 1392 - protein, 19 aa, Artificial
  Short Peptide
FKKLLKKIPPKFKHVALKF

SEQ ID NO: 1393 - protein, 19 aa, Artificial
  Short Peptide
KWKLLKKIPPKFKHVALKF

SEQ ID NO: 1394 - protein, 19 aa, Artificial
  Short Peptide
RWKLLKKIPPKFKHVALKF

SEQ ID NO: 1395 - protein, 19 aa, Artificial
  Short Peptide
FWKLLKKIPPKFKHVALKF

SEQ ID NO: 1396 - protein, 19 aa, Artificial
  Short Peptide
KKKKLKKIPPKFKHVALKF

SEQ ID NO: 1397 - protein, 19 aa, Artificial
  Short Peptide
RKKKLKKIPPKFKHVALKF

SEQ ID NO: 1398 - protein, 19 aa, Artificial
  Short Peptide
FKKKLKKIPPKFKHVALKF

SEQ ID NO: 1399 - protein, 19 aa, Artificial
  Short Peptide
KWKKLKKIPPKFKHVALKF

SEQ ID NO: 1400 - protein, 19 aa, Artificial
  Short Peptide
RWKKLKKIPPKFKHVALKF

SEQ ID NO: 1401 - protein, 19 aa, Artificial
  Short Peptide
FWKKLKKIPPKFKHVALKF

SEQ ID NO: 1402 - protein, 18 aa, Artificial
  Short Peptide
KKKLFLKIPKFKHVALKF

SEQ ID NO: 1403 - protein, 18 aa, Artificial
  Short Peptide
RKKLFLKIPKFKHVALKF

SEQ ID NO: 1404 - protein, 18 aa, Artificial
  Short Peptide
FKKLFLKIPKFKHVALKF

SEQ ID NO: 1405 - protein, 18 aa, Artificial
  Short Peptide
KWKLFLKIPKFKHVALKF

SEQ ID NO: 1406 - protein, 18 aa, Artificial
  Short Peptide
RWKLFLKIPKFKHVALKF

SEQ ID NO: 1407 - protein, 18 aa, Artificial
  Short Peptide
FWKLFLKIPKFKHVALKF

SEQ ID NO: 1408 - protein, 18 aa, Artificial
  Short Peptide
KKKKFLKIPKFKHVALKF

SEQ ID NO: 1409 - protein, 18 aa, Artificial
  Short Peptide
RKKKFLKIPKFKHVALKF

SEQ ID NO: 1410 - protein, 18 aa, Artificial
  Short Peptide
FKKKFLKIPKFKHVALKF

SEQ ID NO: 1411 - protein, 18 aa, Artificial
  Short Peptide
KWKKFLKIPKFKHVALKF

SEQ ID NO: 1412 - protein, 18 aa, Artificial
  Short Peptide
RWKKFLKIPKFKHVALKF

SEQ ID NO: 1413 - protein, 18 aa, Artificial
  Short Peptide
FWKKFLKIPKFKHVALKF

SEQ ID NO: 1414 - protein, 18 aa, Artificial
  Short Peptide
KKKLLLKIPKFKHVALKF

SEQ ID NO: 1415 - protein, 18 aa, Artificial
  Short Peptide
RKKLLLKIPKFKHVALKF

SEQ ID NO: 1416 - protein, 18 aa, Artificial
  Short Peptide
FKKLLLKIPKFKHVALKF

SEQ ID NO: 1417 - protein, 18 aa, Artificial
  Short Peptide
KWKLLLKIPKFKHVALKF

SEQ ID NO: 1418 - protein, 18 aa, Artificial
  Short Peptide
RWKLLLKIPKFKHVALKF

SEQ ID NO: 1419 - protein, 18 aa, Artificial
  Short Peptide
FWKLLLKIPKFKHVALKF

SEQ ID NO: 1420 - protein, 18 aa, Artificial
  Short Peptide
KKKKLLKIPKFKHVALKF

SEQ ID NO: 1421 - protein, 18 aa, Artificial
  Short Peptide
RKKKLLKIPKFKHVALKF

SEQ ID NO: 1422 - protein, 18 aa, Artificial
  Short Peptide
FKKKLLKIPKFKHVALKF

SEQ ID NO: 1423 - protein, 18 aa, Artificial
  Short Peptide
KWKKLLKIPKFKHVALKF

SEQ ID NO: 1424 - protein, 18 aa, Artificial
  Short Peptide
RWKKLLKIPKFKHVALKF

SEQ ID NO: 1425 - protein, 18 aa, Artificial
  Short Peptide
FWKKLLKIPKFKHVALKF

SEQ ID NO: 1426 - protein, 18 aa, Artificial
  Short Peptide
KKKLFKKIPKFKHVALKF

SEQ ID NO: 1427 - protein, 18 aa, Artificial
  Short Peptide
RKKLFKKIPKFKHVALKF

SEQ ID NO: 1428 - protein, 18 aa, Artificial
  Short Peptide
FKKLFKKIPKFKHVALKF

SEQ ID NO: 1429 - protein, 18 aa, Artificial
  Short Peptide
KWKLFKKIPKFKHVALKF

SEQ ID NO: 1430 - protein, 18 aa, Artificial
  Short Peptide
RWKLFKKIPKFKHVALKF

SEQ ID NO: 1431 - protein, 18 aa, Artificial
  Short Peptide
FWKLFKKIPKFKHVALKF

SEQ ID NO: 1432 - protein, 18 aa, Artificial
  Short Peptide
KKKKFKKIPKFKHVALKF

SEQ ID NO: 1433 - protein, 18 aa, Artificial
  Short Peptide
RKKKFKKIPKFKHVALKF

SEQ ID NO: 1434 - protein, 18 aa, Artificial
  Short Peptide
FKKKFKKIPKFKHVALKF

SEQ ID NO: 1435 - protein, 18 aa, Artificial
  Short Peptide
KWKKFKKIPKFKHVALKF

SEQ ID NO: 1436 - protein, 18 aa, Artificial
  Short Peptide
RWKKFKKIPKFKHVALKF

SEQ ID NO: 1437 - protein, 18 aa, Artificial
  Short Peptide
FWKKFKKIPKFKHVALKF

SEQ ID NO: 1438 - protein, 18 aa, Artificial
  Short Peptide
KKKLLKKIPKFKHVALKF

SEQ ID NO: 1439 - protein, 18 aa, Artificial
  Short Peptide
RKKLLKKIPKFKHVALKF

SEQ ID NO: 1440 - protein, 18 aa, Artificial
  Short Peptide
FKKLLKKIPKFKHVALKF

SEQ ID NO: 1441 - protein, 18 aa, Artificial
  Short Peptide
KWKLLKKIPKFKHVALKF

SEQ ID NO: 1442 - protein, 18 aa, Artificial
  Short Peptide
RWKLLKKIPKFKHVALKF

SEQ ID NO: 1443 - protein, 18 aa, Artificial
  Short Peptide
FWKLLKKIPKFKHVALKF

SEQ ID NO: 1444 - protein, 18 aa, Artificial
  Short Peptide
KKKKLKKIPKFKHVALKF

SEQ ID NO: 1445 - protein, 18 aa, Artificial
  Short Peptide
RKKKLKKIPKFKHVALKF

SEQ ID NO: 1446 - protein, 18 aa, Artificial
  Short Peptide
FKKKLKKIPKFKHVALKF

SEQ ID NO: 1447 - protein, 18 aa, Artificial
  Short Peptide
KWKKLKKIPKFKHVALKF

SEQ ID NO: 1448 - protein, 18 aa, Artificial
  Short Peptide
RWKKLKKIPKFKHVALKF

SEQ ID NO: 1449 - protein, 18 aa, Artificial
  Short Peptide
FWKKLKKIPKFKHVALKF

SEQ ID NO: 1450 - protein, 20 aa, Artificial
  Short Peptide
KKKLFLKIPPPKFLKVALKF

SEQ ID NO: 1451 - protein, 20 aa, Artificial
  Short Peptide
RKKLFLKIPPPKFLKVALKF

SEQ ID NO: 1452 - protein, 20 aa, Artificial
  Short Peptide
FKKLFLKIPPPKFLKVALKF

SEQ ID NO: 1453 - protein, 20 aa, Artificial
  Short Peptide
KWKLFLKIPPPKFLKVALKF

SEQ ID NO: 1454 - protein, 20 aa, Artificial
  Short Peptide
RWKLFLKIPPPKFLKVALKF

SEQ ID NO: 1455 - protein, 20 aa, Artificial
  Short Peptide
FWKLFLKIPPPKFLKVALKF

SEQ ID NO: 1456 - protein, 20 aa, Artificial
  Short Peptide
KKKKFLKIPPPKFLKVALKF

SEQ ID NO: 1457 - protein, 20 aa, Artificial
  Short Peptide
RKKKFLKIPPPKFLKVALKF

SEQ ID NO: 1458 - protein, 20 aa, Artificial
  Short Peptide
FKKKFLKIPPPKFLKVALKF

SEQ ID NO: 1459 - protein, 20 aa, Artificial
  Short Peptide
KWKKFLKIPPPKFLKVALKF

SEQ ID NO: 1460 - protein, 20 aa, Artificial
  Short Peptide
RWKKFLKIPPPKFLKVALKF

SEQ ID NO: 1461 - protein, 20 aa, Artificial
  Short Peptide
FWKKFLKIPPPKFLKVALKF

SEQ ID NO: 1462 - protein, 20 aa, Artificial
  Short Peptide
KKKLLLKIPPPKFLKVALKF

SEQ ID NO: 1463 - protein, 20 aa, Artificial
  Short Peptide
RKKLLLKIPPPKFLKVALKF

SEQ ID NO: 1464 - protein, 20 aa, Artificial
  Short Peptide
FKKLLLKIPPPKFLKVALKF

SEQ ID NO: 1465 - protein, 20 aa, Artificial
  Short Peptide
KWKLLLKIPPPKFLKVALKF

SEQ ID NO: 1466 - protein, 20 aa, Artificial
  Short Peptide
RWKLLLKIPPPKFLKVALKF

SEQ ID NO: 1467 - protein, 20 aa, Artificial
  Short Peptide
FWKLLLKIPPPKFLKVALKF

SEQ ID NO: 1468 - protein, 20 aa, Artificial
  Short Peptide
KKKKLLKIPPPKFLKVALKF

SEQ ID NO: 1469 - protein, 20 aa, Artificial
  Short Peptide
RKKKLLKIPPPKFLKVALKF

SEQ ID NO: 1470 - protein, 20 aa, Artificial
  Short Peptide
FKKKLLKIPPPKFLKVALKF

SEQ ID NO: 1471 - protein, 20 aa, Artificial
  Short Peptide
KWKKLLKIPPPKFLKVALKF

SEQ ID NO: 1472 - protein, 20 aa, Artificial
  Short Peptide
RWKKLLKIPPPKFLKVALKF

SEQ ID NO: 1473 - protein, 20 aa, Artificial
  Short Peptide
FWKKLLKIPPPKFLKVALKF

SEQ ID NO: 1474 - protein, 20 aa, Artificial
  Short Peptide
KKKLFKKIPPPKFLKVALKF

SEQ ID NO: 1475 - protein, 20 aa, Artificial
  Short Peptide
RKKLFKKIPPPKFLKVALKF

SEQ ID NO: 1476 - protein, 20 aa, Artificial
  Short Peptide
FKKLFKKIPPPKFLKVALKF

SEQ ID NO: 1477 - protein, 20 aa, Artificial
  Short Peptide
KWKLFKKIPPPKFLKVALKF

SEQ ID NO: 1478 - protein, 20 aa, Artificial
  Short Peptide
RWKLFKKIPPPKFLKVALKF

SEQ ID NO: 1479 - protein, 20 aa, Artificial
  Short Peptide
FWKLFKKIPPPKFLKVALKF

SEQ ID NO: 1480 - protein, 20 aa, Artificial
  Short Peptide
KKKKFKKIPPPKFLKVALKF

SEQ ID NO: 1481 - protein, 20 aa, Artificial
  Short Peptide
RKKKFKKIPPPKFLKVALKF

SEQ ID NO: 1482 - protein, 20 aa, Artificial
  Short Peptide
FKKKFKKIPPPKFLKVALKF

SEQ ID NO: 1483 - protein, 20 aa, Artificial
  Short Peptide
KWKKFKKIPPPKFLKVALKF

SEQ ID NO: 1484 - protein, 20 aa, Artificial
  Short Peptide
RWKKFKKIPPPKFLKVALKF

SEQ ID NO: 1485 - protein, 20 aa, Artificial
  Short Peptide
FWKKFKKIPPPKFLKVALKF

SEQ ID NO: 1486 - protein, 20 aa, Artificial
  Short Peptide
KKKLLKKIPPPKFLKVALKF

SEQ ID NO: 1487 - protein, 20 aa, Artificial
  Short Peptide
RKKLLKKIPPPKFLKVALKF

SEQ ID NO: 1488 - protein, 20 aa, Artificial
  Short Peptide
FKKLLKKIPPPKFLKVALKF

SEQ ID NO: 1489 - protein, 20 aa, Artificial
  Short Peptide
KWKLLKKIPPPKFLKVALKF

SEQ ID NO: 1490 - protein, 20 aa, Artificial
  Short Peptide
RWKLLKKIPPPKFLKVALKF

SEQ ID NO: 1491 - protein, 20 aa, Artificial
  Short Peptide
FWKLLKKIPPPKFLKVALKF

SEQ ID NO: 1492 - protein, 20 aa, Artificial
  Short Peptide
KKKKLKKIPPPKFLKVALKF

SEQ ID NO: 1493 - protein, 20 aa, Artificial
  Short Peptide
RKKKLKKIPPPKFLKVALKF

SEQ ID NO: 1494 - protein, 20 aa, Artificial
  Short Peptide
FKKKLKKIPPPKFLKVALKF

SEQ ID NO: 1495 - protein, 20 aa, Artificial
  Short Peptide
KWKKLKKIPPPKFLKVALKF

SEQ ID NO: 1496 - protein, 20 aa, Artificial
  Short Peptide
RWKKLKKIPPPKFLKVALKF

SEQ ID NO: 1497 - protein, 20 aa, Artificial
  Short Peptide
FWKKLKKIPPPKFLKVALKF

SEQ ID NO: 1498 - protein, 19 aa, Artificial
  Short Peptide
KKKLFLKIPPKFLKVALKF

SEQ ID NO: 1499 - protein, 19 aa, Artificial
  Short Peptide
RKKLFLKIPPKFLKVALKF

SEQ ID NO: 1500 - protein, 19 aa, Artificial
  Short Peptide
FKKLFLKIPPKFLKVALKF

SEQ ID NO: 1501 - protein, 19 aa, Artificial
  Short Peptide
KWKLFLKIPPKFLKVALKF

SEQ ID NO: 1502 - protein, 19 aa, Artificial
  Short Peptide
RWKLFLKIPPKFLKVALKF

SEQ ID NO: 1503 - protein, 19 aa, Artificial
  Short Peptide
FWKLFLKIPPKFLKVALKF

SEQ ID NO: 1504 - protein, 19 aa, Artificial
  Short Peptide
KKKKFLKIPPKFLKVALKF

SEQ ID NO: 1505 - protein, 19 aa, Artificial
  Short Peptide
RKKKFLKIPPKFLKVALKF

SEQ ID NO: 1506 - protein, 19 aa, Artificial
  Short Peptide
FKKKFLKIPPKFLKVALKF

SEQ ID NO: 1507 - protein, 19 aa, Artificial
  Short Peptide
KWKKFLKIPPKFLKVALKF

SEQ ID NO: 1508 - protein, 19 aa, Artificial
  Short Peptide
RWKKFLKIPPKFLKVALKF

SEQ ID NO: 1509 - protein, 19 aa, Artificial
  Short Peptide
FWKKFLKIPPKFLKVALKF

SEQ ID NO: 1510 - protein, 19 aa, Artificial
  Short Peptide
KKKLLLKIPPKFLKVALKF

SEQ ID NO: 1511 - protein, 19 aa, Artificial
  Short Peptide
RKKLLLKIPPKFLKVALKF

SEQ ID NO: 1512 - protein, 19 aa, Artificial
  Short Peptide
FKKLLLKIPPKFLKVALKF

SEQ ID NO: 1513 - protein, 19 aa, Artificial
  Short Peptide
KWKLLLKIPPKFLKVALKF

SEQ ID NO: 1514 - protein, 19 aa, Artificial
  Short Peptide
RWKLLLKIPPKFLKVALKF

SEQ ID NO: 1515 - protein, 19 aa, Artificial
  Short Peptide
FWKLLLKIPPKFLKVALKF

SEQ ID NO: 1516 - protein, 19 aa, Artificial
  Short Peptide
KKKKLLKIPPKFLKVALKF

SEQ ID NO: 1517 - protein, 19 aa, Artificial
  Short Peptide
RKKKLLKIPPKFLKVALKF

SEQ ID NO: 1518 - protein, 19 aa, Artificial
  Short Peptide
FKKKLLKIPPKFLKVALKF

SEQ ID NO: 1519 - protein, 19 aa, Artificial
  Short Peptide
KWKKLLKIPPKFLKVALKF

SEQ ID NO: 1520 - protein, 19 aa, Artificial
  Short Peptide
RWKKLLKIPPKFLKVALKF

SEQ ID NO: 1521 - protein, 19 aa, Artificial
  Short Peptide
FWKKLLKIPPKFLKVALKF

SEQ ID NO: 1522 - protein, 19 aa, Artificial
  Short Peptide
KKKLFKKIPPKFLKVALKF

SEQ ID NO: 1523 - protein, 19 aa, Artificial
  Short Peptide
RKKLFKKIPPKFLKVALKF

SEQ ID NO: 1524 - protein, 19 aa, Artificial
  Short Peptide
FKKLFKKIPPKFLKVALKF

SEQ ID NO: 1525 - protein, 19 aa, Artificial
  Short Peptide
KWKLFKKIPPKFLKVALKF

SEQ ID NO: 1526 - protein, 19 aa, Artificial
  Short Peptide
RWKLFKKIPPKFLKVALKF

SEQ ID NO: 1527 - protein, 19 aa, Artificial
  Short Peptide
FWKLFKKIPPKFLKVALKF

SEQ ID NO: 1528 - protein, 19 aa, Artificial
  Short Peptide
KKKKFKKIPPKFLKVALKF

SEQ ID NO: 1529 - protein, 19 aa, Artificial
  Short Peptide
RKKKFKKIPPKFLKVALKF

SEQ ID NO: 1530 - protein, 19 aa, Artificial
  Short Peptide
FKKKFKKIPPKFLKVALKF

SEQ ID NO: 1531 - protein, 19 aa, Artificial
  Short Peptide
KWKKFKKIPPKFLKVALKF

SEQ ID NO: 1532 - protein, 19 aa, Artificial
  Short Peptide
RWKKFKKIPPKFLKVALKF

SEQ ID NO: 1533 - protein, 19 aa, Artificial
  Short Peptide
FWKKFKKIPPKFLKVALKF

SEQ ID NO: 1534 - protein, 19 aa, Artificial
  Short Peptide
KKKLLKKIPPKFLKVALKF

SEQ ID NO: 1535 - protein, 19 aa, Artificial
  Short Peptide
RKKLLKKIPPKFLKVALKF

SEQ ID NO: 1536 - protein, 19 aa, Artificial
  Short Peptide
FKKLLKKIPPKFLKVALKF

SEQ ID NO: 1537 - protein, 19 aa, Artificial
  Short Peptide
KWKLLKKIPPKFLKVALKF

SEQ ID NO: 1538 - protein, 19 aa, Artificial
  Short Peptide
RWKLLKKIPPKFLKVALKF

SEQ ID NO: 1539 - protein, 19 aa, Artificial
  Short Peptide
FWKLLKKIPPKFLKVALKF

SEQ ID NO: 1540 - protein, 19 aa, Artificial
  Short Peptide
KKKKLKKIPPKFLKVALKF

SEQ ID NO: 1541 - protein, 19 aa, Artificial
  Short Peptide
RKKKLKKIPPKFLKVALKF

SEQ ID NO: 1542 - protein, 19 aa, Artificial
  Short Peptide
FKKKLKKIPPKFLKVALKF

SEQ ID NO: 1543 - protein, 19 aa, Artificial
  Short Peptide
KWKKLKKIPPKFLKVALKF

SEQ ID NO: 1544 - protein, 19 aa, Artificial
  Short Peptide
RWKKLKKIPPKFLKVALKF

SEQ ID NO: 1545 - protein, 19 aa, Artificial
  Short Peptide
FWKKLKKIPPKFLKVALKF

SEQ ID NO: 1546 - protein, 18 aa, Artificial
  Short Peptide
KKKLFLKIPKFLKVALKF

SEQ ID NO: 1547 - protein, 18 aa, Artificial
  Short Peptide
RKKLFLKIPKFLKVALKF

SEQ ID NO: 1548 - protein, 18 aa, Artificial
  Short Peptide
FKKLFLKIPKFLKVALKF

SEQ ID NO: 1549 - protein, 18 aa, Artificial
  Short Peptide
KWKLFLKIPKFLKVALKF

SEQ ID NO: 1550 - protein, 18 aa, Artificial
  Short Peptide
RWKLFLKIPKFLKVALKF

SEQ ID NO: 1551 - protein, 18 aa, Artificial
  Short Peptide
FWKLFLKIPKFLKVALKF

SEQ ID NO: 1552 - protein, 18 aa, Artificial
  Short Peptide
KKKKFLKIPKFLKVALKF

SEQ ID NO: 1553 - protein, 18 aa, Artificial
  Short Peptide
RKKKFLKIPKFLKVALKF

SEQ ID NO: 1554 - protein, 18 aa, Artificial
  Short Peptide
FKKKFLKIPKFLKVALKF

SEQ ID NO: 1555 - protein, 18 aa, Artificial
  Short Peptide
KWKKFLKIPKFLKVALKF

SEQ ID NO: 1556 - protein, 18 aa, Artificial
  Short Peptide
RWKKFLKIPKFLKVALKF

SEQ ID NO: 1557 - protein, 18 aa, Artificial
  Short Peptide
FWKKFLKIPKFLKVALKF

SEQ ID NO: 1558 - protein, 18 aa, Artificial
  Short Peptide
KKKLLLKIPKFLKVALKF

SEQ ID NO: 1559 - protein, 18 aa, Artificial
  Short Peptide
RKKLLLKIPKFLKVALKF

SEQ ID NO: 1560 - protein, 18 aa, Artificial
  Short Peptide
FKKLLLKIPKFLKVALKF

SEQ ID NO: 1561 - protein, 18 aa, Artificial
  Short Peptide
KWKLLLKIPKFLKVALKF

SEQ ID NO: 1562 - protein, 18 aa, Artificial
  Short Peptide
RWKLLLKIPKFLKVALKF

SEQ ID NO: 1563 - protein, 18 aa, Artificial
  Short Peptide
FWKLLLKIPKFLKVALKF

SEQ ID NO: 1564 - protein, 18 aa, Artificial
  Short Peptide
KKKKLLKIPKFLKVALKF

SEQ ID NO: 1565 - protein, 18 aa, Artificial
  Short Peptide
RKKKLLKIPKFLKVALKF

SEQ ID NO: 1566 - protein, 18 aa, Artificial
  Short Peptide
FKKKLLKIPKFLKVALKF

SEQ ID NO: 1567 - protein, 18 aa, Artificial
  Short Peptide
KWKKLLKIPKFLKVALKF

SEQ ID NO: 1568 - protein, 18 aa, Artificial
  Short Peptide
RWKKLLKIPKFLKVALKF

SEQ ID NO: 1569 - protein, 18 aa, Artificial
  Short Peptide
FWKKLLKIPKFLKVALKF

SEQ ID NO: 1570 - protein, 18 aa, Artificial
  Short Peptide
KKKLFKKIPKFLKVALKF

SEQ ID NO: 1571 - protein, 18 aa, Artificial
  Short Peptide
RKKLFKKIPKFLKVALKF

SEQ ID NO: 1572 - protein, 18 aa, Artificial
  Short Peptide
FKKLFKKIPKFLKVALKF

SEQ ID NO: 1573 - protein, 18 aa, Artificial
  Short Peptide
KWKLFKKIPKFLKVALKF

SEQ ID NO: 1574 - protein, 18 aa, Artificial
  Short Peptide
RWKLFKKIPKFLKVALKF

SEQ ID NO: 1575 - protein, 18 aa, Artificial
  Short Peptide
FWKLFKKIPKFLKVALKF

SEQ ID NO: 1576 - protein, 18 aa, Artificial
  Short Peptide
KKKKFKKIPKFLKVALKF

SEQ ID NO: 1577 - protein, 18 aa, Artificial
  Short Peptide
RKKKFKKIPKFLKVALKF

SEQ ID NO: 1578 - protein, 18 aa, Artificial
  Short Peptide
FKKKFKKIPKFLKVALKF

SEQ ID NO: 1579 - protein, 18 aa, Artificial
  Short Peptide
KWKKFKKIPKFLKVALKF

SEQ ID NO: 1580 - protein, 18 aa, Artificial
  Short Peptide
RWKKFKKIPKFLKVALKF

SEQ ID NO: 1581 - protein, 18 aa, Artificial
  Short Peptide
FWKKFKKIPKFLKVALKF

SEQ ID NO: 1582 - protein, 18 aa, Artificial
  Short Peptide
KKKLLKKIPKFLKVALKF

SEQ ID NO: 1583 - protein, 18 aa, Artificial
  Short Peptide
RKKLLKKIPKFLKVALKF

SEQ ID NO: 1584 - protein, 18 aa, Artificial
  Short Peptide
FKKLLKKIPKFLKVALKF

SEQ ID NO: 1585 - protein, 18 aa, Artificial
  Short Peptide
KWKLLKKIPKFLKVALKF

SEQ ID NO: 1586 - protein, 18 aa, Artificial
  Short Peptide
RWKLLKKIPKFLKVALKF

SEQ ID NO: 1587 - protein, 18 aa, Artificial
  Short Peptide
FWKLLKKIPKFLKVALKF

SEQ ID NO: 1588 - protein, 18 aa, Artificial
  Short Peptide
KKKKLKKIPKFLKVALKF

SEQ ID NO: 1589 - protein, 18 aa, Artificial
  Short Peptide
RKKKLKKIPKFLKVALKF

SEQ ID NO: 1590 - protein, 18 aa, Artificial
  Short Peptide
FKKKLKKIPKFLKVALKF

SEQ ID NO: 1591 - protein, 18 aa, Artificial
  Short Peptide
KWKKLKKIPKFLKVALKF

SEQ ID NO: 1592 - protein, 18 aa, Artificial
  Short Peptide
RWKKLKKIPKFLKVALKF

SEQ ID NO: 1593 - protein, 18 aa, Artificial
  Short Peptide
FWKKLKKIPKFLKVALKF

SEQ ID NO: 1594 - protein, 20 aa, Artificial
  Short Peptide
KKKLFLKIPPPKFKKVALKF

SEQ ID NO: 1595 - protein, 20 aa, Artificial
  Short Peptide
RKKLFLKIPPPKFKKVALKF

SEQ ID NO: 1596 - protein, 20 aa, Artificial
  Short Peptide
FKKLFLKIPPPKFKKVALKF

SEQ ID NO: 1597 - protein, 20 aa, Artificial
  Short Peptide
KWKLFLKIPPPKFKKVALKF

SEQ ID NO: 1598 - protein, 20 aa, Artificial
  Short Peptide
RWKLFLKIPPPKFKKVALKF

SEQ ID NO: 1599 - protein, 20 aa, Artificial
  Short Peptide
FWKLFLKIPPPKFKKVALKF

SEQ ID NO: 1600 - protein, 20 aa, Artificial
  Short Peptide
KKKKFLKIPPPKFKKVALKF

SEQ ID NO: 1601 - protein, 20 aa, Artificial
  Short Peptide
RKKKFLKIPPPKFKKVALKF

SEQ ID NO: 1602 - protein, 20 aa, Artificial
  Short Peptide
FKKKFLKIPPPKFKKVALKF

SEQ ID NO: 1603 - protein, 20 aa, Artificial
  Short Peptide
KWKKFLKIPPPKFKKVALKF

SEQ ID NO: 1604 - protein, 20 aa, Artificial
  Short Peptide
RWKKFLKIPPPKFKKVALKF

SEQ ID NO: 1605 - protein, 20 aa, Artificial
  Short Peptide
FWKKFLKIPPPKFKKVALKF

SEQ ID NO: 1606 - protein, 20 aa, Artificial
  Short Peptide
KKKLLLKIPPPKFKKVALKF

SEQ ID NO: 1607 - protein, 20 aa, Artificial
  Short Peptide
RKKLLLKIPPPKFKKVALKF

SEQ ID NO: 1608 - protein, 20 aa, Artificial
  Short Peptide
FKKLLLKIPPPKFKKVALKF

SEQ ID NO: 1609 - protein, 20 aa, Artificial
  Short Peptide
KWKLLLKIPPPKFKKVALKF

SEQ ID NO: 1610 - protein, 20 aa, Artificial
  Short Peptide
RWKLLLKIPPPKFKKVALKF

SEQ ID NO: 1611 - protein, 20 aa, Artificial
  Short Peptide
FWKLLLKIPPPKFKKVALKF

SEQ ID NO: 1612 - protein, 20 aa, Artificial
  Short Peptide
KKKKLLKIPPPKFKKVALKF

SEQ ID NO: 1613 - protein, 20 aa, Artificial
  Short Peptide
RKKKLLKIPPPKFKKVALKF

SEQ ID NO: 1614 - protein, 20 aa, Artificial
  Short Peptide
FKKKLLKIPPPKFKKVALKF

SEQ ID NO: 1615 - protein, 20 aa, Artificial
  Short Peptide
KWKKLLKIPPPKFKKVALKF

SEQ ID NO: 1616 - protein, 20 aa, Artificial
  Short Peptide
RWKKLLKIPPPKFKKVALKF

SEQ ID NO: 1617 - protein, 20 aa, Artificial
  Short Peptide
FWKKLLKIPPPKFKKVALKF

SEQ ID NO: 1618 - protein, 20 aa, Artificial
  Short Peptide
KKKLFKKIPPPKFKKVALKF

SEQ ID NO: 1619 - protein, 20 aa, Artificial
  Short Peptide
RKKLFKKIPPPKFKKVALKF

SEQ ID NO: 1620 - protein, 20 aa, Artificial
  Short Peptide
FKKLFKKIPPPKFKKVALKF

SEQ ID NO: 1621 - protein, 20 aa, Artificial
  Short Peptide
KWKLFKKIPPPKFKKVALKF

SEQ ID NO: 1622 - protein, 20 aa, Artificial
  Short Peptide
RWKLFKKIPPPKFKKVALKF

SEQ ID NO: 1623 - protein, 20 aa, Artificial
  Short Peptide
FWKLFKKIPPPKFKKVALKF

SEQ ID NO: 1624 - protein, 20 aa, Artificial
  Short Peptide
KKKKFKKIPPPKFKKVALKF

SEQ ID NO: 1625 - protein, 20 aa, Artificial
  Short Peptide
RKKKFKKIPPPKFKKVALKF

SEQ ID NO: 1626 - protein, 20 aa, Artificial
  Short Peptide
FKKKFKKIPPPKFKKVALKF

SEQ ID NO: 1627 - protein, 20 aa, Artificial
  Short Peptide
KWKKFKKIPPPKFKKVALKF

SEQ ID NO: 1628 - protein, 20 aa, Artificial
  Short Peptide
RWKKFKKIPPPKFKKVALKF

SEQ ID NO: 1629 - protein, 20 aa, Artificial
  Short Peptide
FWKKFKKIPPPKFKKVALKF

SEQ ID NO: 1630 - protein, 20 aa, Artificial
  Short Peptide
KKKLLKKIPPPKFKKVALKF

SEQ ID NO: 1631 - protein, 20 aa, Artificial
  Short Peptide
RKKLLKKIPPPKFKKVALKF

SEQ ID NO: 1632 - protein, 20 aa, Artificial
  Short Peptide
FKKLLKKIPPPKFKKVALKF

SEQ ID NO: 1633 - protein, 20 aa, Artificial
  Short Peptide
KWKLLKKIPPPKFKKVALKF

SEQ ID NO: 1634 - protein, 20 aa, Artificial
  Short Peptide
RWKLLKKIPPPKFKKVALKF

SEQ ID NO: 1635 - protein, 20 aa, Artificial
  Short Peptide
FWKLLKKIPPPKFKKVALKF

SEQ ID NO: 1636 - protein, 20 aa, Artificial
  Short Peptide
KKKKLKKIPPPKFKKVALKF

SEQ ID NO: 1637 - protein, 20 aa, Artificial
  Short Peptide
RKKKLKKIPPPKFKKVALKF

SEQ ID NO: 1638 - protein, 20 aa, Artificial
  Short Peptide
FKKKLKKIPPPKFKKVALKF

SEQ ID NO: 1639 - protein, 20 aa, Artificial
  Short Peptide
KWKKLKKIPPPKFKKVALKF

SEQ ID NO: 1640 - protein, 20 aa, Artificial
  Short Peptide
RWKKLKKIPPPKFKKVALKF

SEQ ID NO: 1641 - protein, 20 aa, Artificial
  Short Peptide
FWKKLKKIPPPKFKKVALKF

SEQ ID NO: 1642 - protein, 19 aa, Artificial
  Short Peptide
KKKLFLKIPPKFKKVALKF

SEQ ID NO: 1643 - protein, 19 aa, Artificial
  Short Peptide
RKKLFLKIPPKFKKVALKF

SEQ ID NO: 1644 - protein, 19 aa, Artificial
  Short Peptide
FKKLFLKIPPKFKKVALKF

SEQ ID NO: 1645 - protein, 19 aa, Artificial
  Short Peptide
KWKLFLKIPPKFKKVALKF

SEQ ID NO: 1646 - protein, 19 aa, Artificial
  Short Peptide
RWKLFLKIPPKFKKVALKF

SEQ ID NO: 1647 - protein, 19 aa, Artificial
  Short Peptide
FWKLFLKIPPKFKKVALKF

SEQ ID NO: 1648 - protein, 19 aa, Artificial
  Short Peptide
KKKKFLKIPPKFKKVALKF

SEQ ID NO: 1649 - protein, 19 aa, Artificial
  Short Peptide
RKKKFLKIPPKFKKVALKF

SEQ ID NO: 1650 - protein, 19 aa, Artificial
  Short Peptide
FKKKFLKIPPKFKKVALKF

SEQ ID NO: 1651 - protein, 19 aa, Artificial
  Short Peptide
KWKKFLKIPPKFKKVALKF

SEQ ID NO: 1652 - protein, 19 aa, Artificial
  Short Peptide
RWKKFLKIPPKFKKVALKF

SEQ ID NO: 1653 - protein, 19 aa, Artificial
  Short Peptide
FWKKFLKIPPKFKKVALKF

SEQ ID NO: 1654 - protein, 19 aa, Artificial
  Short Peptide
KKKLLLKIPPKFKKVALKF

SEQ ID NO: 1655 - protein, 19 aa, Artificial
  Short Peptide
RKKLLLKIPPKFKKVALKF

SEQ ID NO: 1656 - protein, 19 aa, Artificial
  Short Peptide
FKKLLLKIPPKFKKVALKF

SEQ ID NO: 1657 - protein, 19 aa, Artificial
  Short Peptide
KWKLLLKIPPKFKKVALKF

SEQ ID NO: 1658 - protein, 19 aa, Artificial
  Short Peptide
RWKLLLKIPPKFKKVALKF

SEQ ID NO: 1659 - protein, 19 aa, Artificial
  Short Peptide
FWKLLLKIPPKFKKVALKF

SEQ ID NO: 1660 - protein, 19 aa, Artificial
  Short Peptide
KKKKLLKIPPKFKKVALKF

SEQ ID NO: 1661 - protein, 19 aa, Artificial
  Short Peptide
RKKKLLKIPPKFKKVALKF

SEQ ID NO: 1662 - protein, 19 aa, Artificial
  Short Peptide
FKKKLLKIPPKFKKVALKF

SEQ ID NO: 1663 - protein, 19 aa, Artificial
  Short Peptide
KWKKLLKIPPKFKKVALKF

SEQ ID NO: 1664 - protein, 19 aa, Artificial
  Short Peptide
RWKKLLKIPPKFKKVALKF

SEQ ID NO: 1665 - protein, 19 aa, Artificial
  Short Peptide
FWKKLLKIPPKFKKVALKF

SEQ ID NO: 1666 - protein, 19 aa, Artificial
  Short Peptide
KKKLFKKIPPKFKKVALKF

SEQ ID NO: 1667 - protein, 19 aa, Artificial
  Short Peptide
RKKLFKKIPPKFKKVALKF

SEQ ID NO: 1668 - protein, 19 aa, Artificial
  Short Peptide
FKKLFKKIPPKFKKVALKF

SEQ ID NO: 1669 - protein, 19 aa, Artificial
  Short Peptide
KWKLFKKIPPKFKKVALKF

SEQ ID NO: 1670 - protein, 19 aa, Artificial
  Short Peptide
RWKLFKKIPPKFKKVALKF

SEQ ID NO: 1671 - protein, 19 aa, Artificial
  Short Peptide
FWKLFKKIPPKFKKVALKF

SEQ ID NO: 1672 - protein, 19 aa, Artificial
  Short Peptide
KKKKFKKIPPKFKKVALKF

SEQ ID NO: 1673 - protein, 19 aa, Artificial
  Short Peptide
RKKKFKKIPPKFKKVALKF

SEQ ID NO: 1674 - protein, 19 aa, Artificial
  Short Peptide
FKKKFKKIPPKFKKVALKF

SEQ ID NO: 1675 - protein, 19 aa, Artificial
  Short Peptide
KWKKFKKIPPKFKKVALKF

SEQ ID NO: 1676 - protein, 19 aa, Artificial
  Short Peptide
RWKKFKKIPPKFKKVALKF

SEQ ID NO: 1677 - protein, 19 aa, Artificial
  Short Peptide
FWKKFKKIPPKFKKVALKF

SEQ ID NO: 1678 - protein, 19 aa, Artificial
  Short Peptide
KKKLLKKIPPKFKKVALKF

SEQ ID NO: 1679 - protein, 19 aa, Artificial
  Short Peptide
RKKLLKKIPPKFKKVALKF

SEQ ID NO: 1680 - protein, 19 aa, Artificial
  Short Peptide
FKKLLKKIPPKFKKVALKF

SEQ ID NO: 1681 - protein, 19 aa, Artificial
  Short Peptide
KWKLLKKIPPKFKKVALKF

SEQ ID NO: 1682 - protein, 19 aa, Artificial
  Short Peptide
RWKLLKKIPPKFKKVALKF

SEQ ID NO: 1683 - protein, 19 aa, Artificial
  Short Peptide
FWKLLKKIPPKFKKVALKF

SEQ ID NO: 1684 - protein, 19 aa, Artificial
  Short Peptide
KKKKLKKIPPKFKKVALKF

SEQ ID NO: 1685 - protein, 19 aa, Artificial
  Short Peptide
RKKKLKKIPPKFKKVALKF

SEQ ID NO: 1686 - protein, 19 aa, Artificial
  Short Peptide
FKKKLKKIPPKFKKVALKF

SEQ ID NO: 1687 - protein, 19 aa, Artificial
  Short Peptide
KWKKLKKIPPKFKKVALKF

SEQ ID NO: 1688 - protein, 19 aa, Artificial
  Short Peptide
RWKKLKKIPPKFKKVALKF

SEQ ID NO: 1689 - protein, 19 aa, Artificial
  Short Peptide
FWKKLKKIPPKFKKVALKF

SEQ ID NO: 1690 - protein, 18 aa, Artificial
  Short Peptide
KKKLFLKIPKFKKVALKF

SEQ ID NO: 1691 - protein, 18 aa, Artificial
  Short Peptide
RKKLFLKIPKFKKVALKF

SEQ ID NO: 1692 - protein, 18 aa, Artificial
  Short Peptide
FKKLFLKIPKFKKVALKF

SEQ ID NO: 1693 - protein, 18 aa, Artificial
  Short Peptide
KWKLFLKIPKFKKVALKF

SEQ ID NO: 1694 - protein, 18 aa, Artificial
  Short Peptide
RWKLFLKIPKFKKVALKF

SEQ ID NO: 1695 - protein, 18 aa, Artificial
  Short Peptide
FWKLFLKIPKFKKVALKF

SEQ ID NO: 1696 - protein, 18 aa, Artificial
  Short Peptide
KKKKFLKIPKFKKVALKF

SEQ ID NO: 1697 - protein, 18 aa, Artificial
  Short Peptide
RKKKFLKIPKFKKVALKF

SEQ ID NO: 1698 - protein, 18 aa, Artificial
  Short Peptide
FKKKFLKIPKFKKVALKF

SEQ ID NO: 1699 - protein, 18 aa, Artificial
  Short Peptide
KWKKFLKIPKFKKVALKF

SEQ ID NO: 1700 - protein, 18 aa, Artificial
  Short Peptide
RWKKFLKIPKFKKVALKF

SEQ ID NO: 1701 - protein, 18 aa, Artificial
  Short Peptide
FWKKFLKIPKFKKVALKF

SEQ ID NO: 1702 - protein, 18 aa, Artificial
  Short Peptide
KKKLLLKIPKFKKVALKF

SEQ ID NO: 1703 - protein, 18 aa, Artificial
  Short Peptide
RKKLLLKIPKFKKVALKF

SEQ ID NO: 1704 - protein, 18 aa, Artificial
  Short Peptide
FKKLLLKIPKFKKVALKF

SEQ ID NO: 1705 - protein, 18 aa, Artificial
  Short Peptide
KWKLLLKIPKFKKVALKF

SEQ ID NO: 1706 - protein, 18 aa, Artificial
  Short Peptide
RWKLLLKIPKFKKVALKF

SEQ ID NO: 1707 - protein, 18 aa, Artificial
  Short Peptide
FWKLLLKIPKFKKVALKF

SEQ ID NO: 1708 - protein, 18 aa, Artificial
  Short Peptide
KKKKLLKIPKFKKVALKF

SEQ ID NO: 1709 - protein, 18 aa, Artificial
  Short Peptide
RKKKLLKIPKFKKVALKF

SEQ ID NO: 1710 - protein, 18 aa, Artificial
  Short Peptide
FKKKLLKIPKFKKVALKF

SEQ ID NO: 1711 - protein, 18 aa, Artificial
  Short Peptide
KWKKLLKIPKFKKVALKF

SEQ ID NO: 1712 - protein, 18 aa, Artificial
  Short Peptide
RWKKLLKIPKFKKVALKF

SEQ ID NO: 1713 - protein, 18 aa, Artificial
  Short Peptide
FWKKLLKIPKFKKVALKF

SEQ ID NO: 1714 - protein, 18 aa, Artificial
  Short Peptide
KKKLFKKIPKFKKVALKF

SEQ ID NO: 1715 - protein, 18 aa, Artificial
  Short Peptide
RKKLFKKIPKFKKVALKF

SEQ ID NO: 1716 - protein, 18 aa, Artificial
  Short Peptide
FKKLFKKIPKFKKVALKF

SEQ ID NO: 1717 - protein, 18 aa, Artificial
  Short Peptide
KWKLFKKIPKFKKVALKF

SEQ ID NO: 1718 - protein, 18 aa, Artificial
  Short Peptide
RWKLFKKIPKFKKVALKF

SEQ ID NO: 1719 - protein, 18 aa, Artificial
  Short Peptide
FWKLFKKIPKFKKVALKF

SEQ ID NO: 1720 - protein, 18 aa, Artificial
  Short Peptide
KKKKFKKIPKFKKVALKF

SEQ ID NO: 1721 - protein, 18 aa, Artificial
  Short Peptide
RKKKFKKIPKFKKVALKF

SEQ ID NO: 1722 - protein, 18 aa, Artificial
  Short Peptide
FKKKFKKIPKFKKVALKF

SEQ ID NO: 1723 - protein, 18 aa, Artificial
  Short Peptide
KWKKFKKIPKFKKVALKF

SEQ ID NO: 1724 - protein, 18 aa, Artificial
  Short Peptide
RWKKFKKIPKFKKVALKF

SEQ ID NO: 1725 - protein, 18 aa, Artificial
  Short Peptide
FWKKFKKIPKFKKVALKF

SEQ ID NO: 1726 - protein, 18 aa, Artificial
  Short Peptide
KKKLLKKIPKFKKVALKF

SEQ ID NO: 1727 - protein, 18 aa, Artificial
  Short Peptide
RKKLLKKIPKFKKVALKF

SEQ ID NO: 1728 - protein, 18 aa, Artificial
  Short Peptide
FKKLLKKIPKFKKVALKF

SEQ ID NO: 1729 - protein, 18 aa, Artificial
  Short Peptide
KWKLLKKIPKFKKVALKF

SEQ ID NO: 1730 - protein, 18 aa, Artificial
  Short Peptide
RWKLLKKIPKFKKVALKF

SEQ ID NO: 1731 - protein, 18 aa, Artificial
  Short Peptide
FWKLLKKIPKFKKVALKF

SEQ ID NO: 1732 - protein, 18 aa, Artificial
  Short Peptide
KKKKLKKIPKFKKVALKF

SEQ ID NO: 1733 - protein, 18 aa, Artificial
  Short Peptide
RKKKLKKIPKFKKVALKF

SEQ ID NO: 1734 - protein, 18 aa, Artificial
  Short Peptide
FKKKLKKIPKFKKVALKF

SEQ ID NO: 1735 - protein, 18 aa, Artificial
  Short Peptide
KWKKLKKIPKFKKVALKF

SEQ ID NO: 1736 - protein, 18 aa, Artificial
  Short Peptide
RWKKLKKIPKFKKVALKF

SEQ ID NO: 1737 - protein, 18 aa, Artificial
  Short Peptide
FWKKLKKIPKFKKVALKF

SEQ ID NO: 1738 - protein, 20 aa, Artificial
  Short Peptide
KKKLFLKIPPPKFLHSALKF

SEQ ID NO: 1739 - protein, 20 aa, Artificial
  Short Peptide
RKKLFLKIPPPKFLHSALKF

SEQ ID NO: 1740 - protein, 20 aa, Artificial
  Short Peptide
FKKLFLKIPPPKFLHSALKF

SEQ ID NO: 1741 - protein, 20 aa, Artificial
  Short Peptide
KWKLFLKIPPPKFLHSALKF

SEQ ID NO: 1742 - protein, 20 aa, Artificial
  Short Peptide
RWKLFLKIPPPKFLHSALKF

SEQ ID NO: 1743 - protein, 20 aa, Artificial
  Short Peptide
FWKLFLKIPPPKFLHSALKF

SEQ ID NO: 1744 - protein, 20 aa, Artificial
  Short Peptide
KKKKFLKIPPPKFLHSALKF

SEQ ID NO: 1745 - protein, 20 aa, Artificial
  Short Peptide
RKKKFLKIPPPKFLHSALKF

SEQ ID NO: 1746 - protein, 20 aa, Artificial
  Short Peptide
FKKKFLKIPPPKFLHSALKF

SEQ ID NO: 1747 - protein, 20 aa, Artificial
  Short Peptide
KWKKFLKIPPPKFLHSALKF

SEQ ID NO: 1748 - protein, 20 aa, Artificial
  Short Peptide
RWKKFLKIPPPKFLHSALKF

SEQ ID NO: 1749 - protein, 20 aa, Artificial
  Short Peptide
FWKKFLKIPPPKFLHSALKF

SEQ ID NO: 1750 - protein, 20 aa, Artificial
  Short Peptide
KKKLLLKIPPPKFLHSALKF

SEQ ID NO: 1751 - protein, 20 aa, Artificial
  Short Peptide
RKKLLLKIPPPKFLHSALKF

SEQ ID NO: 1752 - protein, 20 aa, Artificial
  Short Peptide
FKKLLLKIPPPKFLHSALKF

SEQ ID NO: 1753 - protein, 20 aa, Artificial
  Short Peptide
KWKLLLKIPPPKFLHSALKF

SEQ ID NO: 1754 - protein, 20 aa, Artificial
  Short Peptide
RWKLLLKIPPPKFLHSALKF

SEQ ID NO: 1755 - protein, 20 aa, Artificial
  Short Peptide
FWKLLLKIPPPKFLHSALKF

SEQ ID NO: 1756 - protein, 20 aa, Artificial
  Short Peptide
KKKKLLKIPPPKFLHSALKF

SEQ ID NO: 1757 - protein, 20 aa, Artificial
  Short Peptide
RKKKLLKIPPPKFLHSALKF

SEQ ID NO: 1758 - protein, 20 aa, Artificial
  Short Peptide
FKKKLLKIPPPKFLHSALKF

SEQ ID NO: 1759 - protein, 20 aa, Artificial
  Short Peptide
KWKKLLKIPPPKFLHSALKF

SEQ ID NO: 1760 - protein, 20 aa, Artificial
  Short Peptide
RWKKLLKIPPPKFLHSALKF

SEQ ID NO: 1761 - protein, 20 aa, Artificial
  Short Peptide
FWKKLLKIPPPKFLHSALKF

SEQ ID NO: 1762 - protein, 20 aa, Artificial
  Short Peptide
KKKLFKKIPPPKFLHSALKF

SEQ ID NO: 1763 - protein, 20 aa, Artificial
  Short Peptide
RKKLFKKIPPPKFLHSALKF

SEQ ID NO: 1764 - protein, 20 aa, Artificial
  Short Peptide
FKKLFKKIPPPKFLHSALKF

SEQ ID NO: 1765 - protein, 20 aa, Artificial
  Short Peptide
KWKLFKKIPPPKFLHSALKF

SEQ ID NO: 1766 - protein, 20 aa, Artificial
  Short Peptide
RWKLFKKIPPPKFLHSALKF

SEQ ID NO: 1767 - protein, 20 aa, Artificial
  Short Peptide
FWKLFKKIPPPKFLHSALKF

SEQ ID NO: 1768 - protein, 20 aa, Artificial
  Short Peptide
KKKKFKKIPPPKFLHSALKF

SEQ ID NO: 1769 - protein, 20 aa, Artificial
  Short Peptide
RKKKFKKIPPPKFLHSALKF

SEQ ID NO: 1770 - protein, 20 aa, Artificial
  Short Peptide
FKKKFKKIPPPKFLHSALKF

SEQ ID NO: 1771 - protein, 20 aa, Artificial
  Short Peptide
KWKKFKKIPPPKFLHSALKF

SEQ ID NO: 1772 - protein, 20 aa, Artificial
  Short Peptide
RWKKFKKIPPPKFLHSALKF

SEQ ID NO: 1773 - protein, 20 aa, Artificial
  Short Peptide
FWKKFKKIPPPKFLHSALKF

SEQ ID NO: 1774 - protein, 20 aa, Artificial
  Short Peptide
KKKLLKKIPPPKFLHSALKF

SEQ ID NO: 1775 - protein, 20 aa, Artificial
  Short Peptide
RKKLLKKIPPPKFLHSALKF

SEQ ID NO: 1776 - protein, 20 aa, Artificial
  Short Peptide
FKKLLKKIPPPKFLHSALKF

SEQ ID NO: 1777 - protein, 20 aa, Artificial
  Short Peptide
KWKLLKKIPPPKFLHSALKF

SEQ ID NO: 1778 - protein, 20 aa, Artificial
  Short Peptide
RWKLLKKIPPPKFLHSALKF

SEQ ID NO: 1779 - protein, 20 aa, Artificial
  Short Peptide
FWKLLKKIPPPKFLHSALKF

SEQ ID NO: 1780 - protein, 20 aa, Artificial
  Short Peptide
KKKKLKKIPPPKFLHSALKF

SEQ ID NO: 1781 - protein, 20 aa, Artificial
  Short Peptide
RKKKLKKIPPPKFLHSALKF

SEQ ID NO: 1782 - protein, 20 aa, Artificial
  Short Peptide
FKKKLKKIPPPKFLHSALKF

SEQ ID NO: 1783 - protein, 20 aa, Artificial
  Short Peptide
KWKKLKKIPPPKFLHSALKF

SEQ ID NO: 1784 - protein, 20 aa, Artificial
  Short Peptide
RWKKLKKIPPPKFLHSALKF

SEQ ID NO: 1785 - protein, 20 aa, Artificial
  Short Peptide
FWKKLKKIPPPKFLHSALKF

SEQ ID NO: 1786 - protein, 19 aa, Artificial
  Short Peptide
KKKLFLKIPPKFLHSALKF

SEQ ID NO: 1787 - protein, 19 aa, Artificial
  Short Peptide
RKKLFLKIPPKFLHSALKF

SEQ ID NO: 1788 - protein, 19 aa, Artificial
  Short Peptide
FKKLFLKIPPKFLHSALKF

SEQ ID NO: 1789 - protein, 19 aa, Artificial
  Short Peptide
KWKLFLKIPPKFLHSALKF

SEQ ID NO: 1790 - protein, 19 aa, Artificial
  Short Peptide
RWKLFLKIPPKFLHSALKF

SEQ ID NO: 1791 - protein, 19 aa, Artificial
  Short Peptide
FWKLFLKIPPKFLHSALKF

SEQ ID NO: 1792 - protein, 19 aa, Artificial
  Short Peptide
KKKKFLKIPPKFLHSALKF

SEQ ID NO: 1793 - protein, 19 aa, Artificial
  Short Peptide
RKKKFLKIPPKFLHSALKF

SEQ ID NO: 1794 - protein, 19 aa, Artificial
  Short Peptide
FKKKFLKIPPKFLHSALKF

SEQ ID NO: 1795 - protein, 19 aa, Artificial
  Short Peptide
KWKKFLKIPPKFLHSALKF

SEQ ID NO: 1796 - protein, 19 aa, Artificial
  Short Peptide
RWKKFLKIPPKFLHSALKF

SEQ ID NO: 1797 - protein, 19 aa, Artificial
  Short Peptide
FWKKFLKIPPKFLHSALKF

SEQ ID NO: 1798 - protein, 19 aa, Artificial
  Short Peptide
KKKLLLKIPPKFLHSALKF

SEQ ID NO: 1799 - protein, 19 aa, Artificial
  Short Peptide
RKKLLLKIPPKFLHSALKF

SEQ ID NO: 1800 - protein, 19 aa, Artificial
  Short Peptide
FKKLLLKIPPKFLHSALKF

SEQ ID NO: 1801 - protein, 19 aa, Artificial
  Short Peptide
KWKLLLKIPPKFLHSALKF

SEQ ID NO: 1802 - protein, 19 aa, Artificial
  Short Peptide
RWKLLLKIPPKFLHSALKF

SEQ ID NO: 1803 - protein, 19 aa, Artificial
  Short Peptide
FWKLLLKIPPKFLHSALKF

SEQ ID NO: 1804 - protein, 19 aa, Artificial
  Short Peptide
KKKKLLKIPPKFLHSALKF

SEQ ID NO: 1805 - protein, 19 aa, Artificial
  Short Peptide
RKKKLLKIPPKFLHSALKF

SEQ ID NO: 1806 - protein, 19 aa, Artificial
  Short Peptide
FKKKLLKIPPKFLHSALKF

SEQ ID NO: 1807 - protein, 19 aa, Artificial
  Short Peptide
KWKKLLKIPPKFLHSALKF

SEQ ID NO: 1808 - protein, 19 aa, Artificial
  Short Peptide
RWKKLLKIPPKFLHSALKF

SEQ ID NO: 1809 - protein, 19 aa, Artificial
  Short Peptide
FWKKLLKIPPKFLHSALKF

SEQ ID NO: 1810 - protein, 19 aa, Artificial
  Short Peptide
KKKLFKKIPPKFLHSALKF

SEQ ID NO: 1811 - protein, 19 aa, Artificial
  Short Peptide
RKKLFKKIPPKFLHSALKF

SEQ ID NO: 1812 - protein, 19 aa, Artificial
  Short Peptide
FKKLFKKIPPKFLHSALKF

SEQ ID NO: 1813 - protein, 19 aa, Artificial
  Short Peptide
KWKLFKKIPPKFLHSALKF

SEQ ID NO: 1814 - protein, 19 aa, Artificial
  Short Peptide
RWKLFKKIPPKFLHSALKF

SEQ ID NO: 1815 - protein, 19 aa, Artificial
  Short Peptide
FWKLFKKIPPKFLHSALKF

SEQ ID NO: 1816 - protein, 19 aa, Artificial
  Short Peptide
KKKKFKKIPPKFLHSALKF

SEQ ID NO: 1817 - protein, 19 aa, Artificial
  Short Peptide
RKKKFKKIPPKFLHSALKF

SEQ ID NO: 1818 - protein, 19 aa, Artificial
  Short Peptide
FKKKFKKIPPKFLHSALKF

SEQ ID NO: 1819 - protein, 19 aa, Artificial
  Short Peptide
KWKKFKKIPPKFLHSALKF

SEQ ID NO: 1820 - protein, 19 aa, Artificial
  Short Peptide
RWKKFKKIPPKFLHSALKF

SEQ ID NO: 1821 - protein, 19 aa, Artificial
  Short Peptide
FWKKFKKIPPKFLHSALKF

SEQ ID NO: 1822 - protein, 19 aa, Artificial
  Short Peptide
KKKLLKKIPPKFLHSALKF

SEQ ID NO: 1823 - protein, 19 aa, Artificial
  Short Peptide
RKKLLKKIPPKFLHSALKF

SEQ ID NO: 1824 - protein, 19 aa, Artificial
  Short Peptide
FKKLLKKIPPKFLHSALKF

SEQ ID NO: 1825 - protein, 19 aa, Artificial
  Short Peptide
KWKLLKKIPPKFLHSALKF

SEQ ID NO: 1826 - protein, 19 aa, Artificial
  Short Peptide
RWKLLKKIPPKFLHSALKF

SEQ ID NO: 1827 - protein, 19 aa, Artificial
  Short Peptide
FWKLLKKIPPKFLHSALKF

SEQ ID NO: 1828 - protein, 19 aa, Artificial
  Short Peptide
KKKKLKKIPPKFLHSALKF

SEQ ID NO: 1829 - protein, 19 aa, Artificial
  Short Peptide
RKKKLKKIPPKFLHSALKF

SEQ ID NO: 1830 - protein, 19 aa, Artificial
  Short Peptide
FKKKLKKIPPKFLHSALKF

SEQ ID NO: 1831 - protein, 19 aa, Artificial
  Short Peptide
KWKKLKKIPPKFLHSALKF

SEQ ID NO: 1832 - protein, 19 aa, Artificial
  Short Peptide
RWKKLKKIPPKFLHSALKF

SEQ ID NO: 1833 - protein, 19 aa, Artificial
  Short Peptide
FWKKLKKIPPKFLHSALKF

SEQ ID NO: 1834 - protein, 18 aa, Artificial
  Short Peptide
KKKLFLKIPKFLHSALKF

SEQ ID NO: 1835 - protein, 18 aa, Artificial
  Short Peptide
RKKLFLKIPKFLHSALKF

SEQ ID NO: 1836 - protein, 18 aa, Artificial
  Short Peptide
FKKLFLKIPKFLHSALKF

SEQ ID NO: 1837 - protein, 18 aa, Artificial
  Short Peptide
KWKLFLKIPKFLHSALKF

SEQ ID NO: 1838 - protein, 18 aa, Artificial
  Short Peptide
RWKLFLKIPKFLHSALKF

SEQ ID NO: 1839 - protein, 18 aa, Artificial
  Short Peptide
FWKLFLKIPKFLHSALKF

SEQ ID NO: 1840 - protein, 18 aa, Artificial
  Short Peptide
KKKKFLKIPKFLHSALKF

SEQ ID NO: 1841 - protein, 18 aa, Artificial
  Short Peptide
RKKKFLKIPKFLHSALKF

SEQ ID NO: 1842 - protein, 18 aa, Artificial
  Short Peptide
FKKKFLKIPKFLHSALKF

SEQ ID NO: 1843 - protein, 18 aa, Artificial
  Short Peptide
KWKKFLKIPKFLHSALKF

SEQ ID NO: 1844 - protein, 18 aa, Artificial
  Short Peptide
RWKKFLKIPKFLHSALKF

SEQ ID NO: 1845 - protein, 18 aa, Artificial
  Short Peptide
FWKKFLKIPKFLHSALKF

SEQ ID NO: 1846 - protein, 18 aa, Artificial
  Short Peptide
KKKLLLKIPKFLHSALKF

SEQ ID NO: 1847 - protein, 18 aa, Artificial
  Short Peptide
RKKLLLKIPKFLHSALKF

SEQ ID NO: 1848 - protein, 18 aa, Artificial
  Short Peptide
FKKLLLKIPKFLHSALKF

SEQ ID NO: 1849 - protein, 18 aa, Artificial
  Short Peptide
KWKLLLKIPKFLHSALKF

SEQ ID NO: 1850 - protein, 18 aa, Artificial
  Short Peptide
RWKLLLKIPKFLHSALKF

SEQ ID NO: 1851 - protein, 18 aa, Artificial
  Short Peptide
FWKLLLKIPKFLHSALKF

SEQ ID NO: 1852 - protein, 18 aa, Artificial
  Short Peptide
KKKKLLKIPKFLHSALKF

SEQ ID NO: 1853 - protein, 18 aa, Artificial
  Short Peptide
RKKKLLKIPKFLHSALKF

SEQ ID NO: 1854 - protein, 18 aa, Artificial
  Short Peptide
FKKKLLKIPKFLHSALKF

SEQ ID NO: 1855 - protein, 18 aa, Artificial
  Short Peptide
KWKKLLKIPKFLHSALKF

SEQ ID NO: 1856 - protein, 18 aa, Artificial
  Short Peptide
RWKKLLKIPKFLHSALKF

SEQ ID NO: 1857 - protein, 18 aa, Artificial
  Short Peptide
FWKKLLKIPKFLHSALKF

SEQ ID NO: 1858 - protein, 18 aa, Artificial
  Short Peptide
KKKLFKKIPKFLHSALKF

SEQ ID NO: 1859 - protein, 18 aa, Artificial
  Short Peptide
RKKLFKKIPKFLHSALKF

SEQ ID NO: 1860 - protein, 18 aa, Artificial
  Short Peptide
FKKLFKKIPKFLHSALKF

SEQ ID NO: 1861 - protein, 18 aa, Artificial
  Short Peptide
KWKLFKKIPKFLHSALKF

SEQ ID NO: 1862 - protein, 18 aa, Artificial
  Short Peptide
RWKLFKKIPKFLHSALKF

SEQ ID NO: 1863 - protein, 18 aa, Artificial
  Short Peptide
FWKLFKKIPKFLHSALKF

SEQ ID NO: 1864 - protein, 18 aa, Artificial
  Short Peptide
KKKKFKKIPKFLHSALKF

SEQ ID NO: 1865 - protein, 18 aa, Artificial
  Short Peptide
RKKKFKKIPKFLHSALKF

SEQ ID NO: 1866 - protein, 18 aa, Artificial
  Short Peptide
FKKKFKKIPKFLHSALKF

SEQ ID NO: 1867 - protein, 18 aa, Artificial
  Short Peptide
KWKKFKKIPKFLHSALKF

SEQ ID NO: 1868 - protein, 18 aa, Artificial
  Short Peptide
RWKKFKKIPKFLHSALKF

SEQ ID NO: 1869 - protein, 18 aa, Artificial
  Short Peptide
FWKKFKKIPKFLHSALKF

SEQ ID NO: 1870 - protein, 18 aa, Artificial
  Short Peptide
KKKLLKKIPKFLHSALKF

SEQ ID NO: 1871 - protein, 18 aa, Artificial
  Short Peptide
RKKLLKKIPKFLHSALKF

SEQ ID NO: 1872 - protein, 18 aa, Artificial
  Short Peptide
FKKLLKKIPKFLHSALKF

SEQ ID NO: 1873 - protein, 18 aa, Artificial
  Short Peptide
KWKLLKKIPKFLHSALKF

SEQ ID NO: 1874 - protein, 18 aa, Artificial
  Short Peptide
RWKLLKKIPKFLHSALKF

SEQ ID NO: 1875 - protein, 18 aa, Artificial
  Short Peptide
FWKLLKKIPKFLHSALKF

SEQ ID NO: 1876 - protein, 18 aa, Artificial
  Short Peptide
KKKKLKKIPKFLHSALKF

SEQ ID NO: 1877 - protein, 18 aa, Artificial
  Short Peptide
RKKKLKKIPKFLHSALKF

SEQ ID NO: 1878 - protein, 18 aa, Artificial
  Short Peptide
FKKKLKKIPKFLHSALKF

SEQ ID NO: 1879 - protein, 18 aa, Artificial
  Short Peptide
KWKKLKKIPKFLHSALKF

SEQ ID NO: 1880 - protein, 18 aa, Artificial
  Short Peptide
RWKKLKKIPKFLHSALKF

SEQ ID NO: 1881 - protein, 18 aa, Artificial
  Short Peptide
FWKKLKKIPKFLHSALKF

SEQ ID NO: 1882 - protein, 20 aa, Artificial
  Short Peptide
KKKLFLKIPPPKFKHSALKF

SEQ ID NO: 1883 - protein, 20 aa, Artificial
  Short Peptide
RKKLFLKIPPPKFKHSALKF

SEQ ID NO: 1884 - protein, 20 aa, Artificial
  Short Peptide
FKKLFLKIPPPKFKHSALKF

SEQ ID NO: 1885 - protein, 20 aa, Artificial
  Short Peptide
KWKLFLKIPPPKFKHSALKF

SEQ ID NO: 1886 - protein, 20 aa, Artificial
  Short Peptide
RWKLFLKIPPPKFKHSALKF

SEQ ID NO: 1887 - protein, 20 aa, Artificial
  Short Peptide
FWKLFLKIPPPKFKHSALKF

SEQ ID NO: 1888 - protein, 20 aa, Artificial
  Short Peptide
KKKKFLKIPPPKFKHSALKF

SEQ ID NO: 1889 - protein, 20 aa, Artificial
  Short Peptide
RKKKFLKIPPPKFKHSALKF

SEQ ID NO: 1890 - protein, 20 aa, Artificial
  Short Peptide
FKKKFLKIPPPKFKHSALKF

SEQ ID NO: 1891 - protein, 20 aa, Artificial
  Short Peptide
KWKKFLKIPPPKFKHSALKF

SEQ ID NO: 1892 - protein, 20 aa, Artificial
  Short Peptide
RWKKFLKIPPPKFKHSALKF

SEQ ID NO: 1893 - protein, 20 aa, Artificial
  Short Peptide
FWKKFLKIPPPKFKHSALKF

SEQ ID NO: 1894 - protein, 20 aa, Artificial
  Short Peptide
KKKLLLKIPPPKFKHSALKF

SEQ ID NO: 1895 - protein, 20 aa, Artificial
  Short Peptide
RKKLLLKIPPPKFKHSALKF

SEQ ID NO: 1896 - protein, 20 aa, Artificial
  Short Peptide
FKKLLLKIPPPKFKHSALKF

SEQ ID NO: 1897 - protein, 20 aa, Artificial
  Short Peptide
KWKLLLKIPPPKFKHSALKF

SEQ ID NO: 1898 - protein, 20 aa, Artificial
  Short Peptide
RWKLLLKIPPPKFKHSALKF

SEQ ID NO: 1899 - protein, 20 aa, Artificial
  Short Peptide
FWKLLLKIPPPKFKHSALKF

SEQ ID NO: 1900 - protein, 20 aa, Artificial
  Short Peptide
KKKKLLKIPPPKFKHSALKF

SEQ ID NO: 1901 - protein, 20 aa, Artificial
  Short Peptide
RKKKLLKIPPPKFKHSALKF

SEQ ID NO: 1902 - protein, 20 aa, Artificial
  Short Peptide
FKKKLLKIPPPKFKHSALKF

SEQ ID NO: 1903 - protein, 20 aa, Artificial
  Short Peptide
KWKKLLKIPPPKFKHSALKF

SEQ ID NO: 1904 - protein, 20 aa, Artificial
  Short Peptide
RWKKLLKIPPPKFKHSALKF

SEQ ID NO: 1905 - protein, 20 aa, Artificial
  Short Peptide
FWKKLLKIPPPKFKHSALKF

SEQ ID NO: 1906 - protein, 20 aa, Artificial
  Short Peptide
KKKLFKKIPPPKFKHSALKF

SEQ ID NO: 1907 - protein, 20 aa, Artificial
  Short Peptide
RKKLFKKIPPPKFKHSALKF

SEQ ID NO: 1908 - protein, 20 aa, Artificial
  Short Peptide
FKKLFKKIPPPKFKHSALKF

SEQ ID NO: 1909 - protein, 20 aa, Artificial
  Short Peptide
KWKLFKKIPPPKFKHSALKF

SEQ ID NO: 1910 - protein, 20 aa, Artificial
  Short Peptide
RWKLFKKIPPPKFKHSALKF

SEQ ID NO: 1911 - protein, 20 aa, Artificial
  Short Peptide
FWKLFKKIPPPKFKHSALKF

SEQ ID NO: 1912 - protein, 20 aa, Artificial
  Short Peptide
KKKKFKKIPPPKFKHSALKF

SEQ ID NO: 1913 - protein, 20 aa, Artificial
  Short Peptide
RKKKFKKIPPPKFKHSALKF

SEQ ID NO: 1914 - protein, 20 aa, Artificial
  Short Peptide
FKKKFKKIPPPKFKHSALKF

SEQ ID NO: 1915 - protein, 20 aa, Artificial
  Short Peptide
KWKKFKKIPPPKFKHSALKF

SEQ ID NO: 1916 - protein, 20 aa, Artificial
  Short Peptide
RWKKFKKIPPPKFKHSALKF

SEQ ID NO: 1917 - protein, 20 aa, Artificial
  Short Peptide
FWKKFKKIPPPKFKHSALKF

SEQ ID NO: 1918 - protein, 20 aa, Artificial
  Short Peptide
KKKLLKKIPPPKFKHSALKF

SEQ ID NO: 1919 - protein, 20 aa, Artificial
  Short Peptide
RKKLLKKIPPPKFKHSALKF

SEQ ID NO: 1920 - protein, 20 aa, Artificial
  Short Peptide
FKKLLKKIPPPKFKHSALKF

SEQ ID NO: 1921 - protein, 20 aa, Artificial
  Short Peptide
KWKLLKKIPPPKFKHSALKF

SEQ ID NO: 1922 - protein, 20 aa, Artificial
  Short Peptide
RWKLLKKIPPPKFKHSALKF

SEQ ID NO: 1923 - protein, 20 aa, Artificial
  Short Peptide
FWKLLKKIPPPKFKHSALKF

SEQ ID NO: 1924 - protein, 20 aa, Artificial
  Short Peptide
KKKKLKKIPPPKFKHSALKF

SEQ ID NO: 1925 - protein, 20 aa, Artificial
  Short Peptide
RKKKLKKIPPPKFKHSALKF

SEQ ID NO: 1926 - protein, 20 aa, Artificial
  Short Peptide
FKKKLKKIPPPKFKHSALKF

SEQ ID NO: 1927 - protein, 20 aa, Artificial
  Short Peptide
KWKKLKKIPPPKFKHSALKF

SEQ ID NO: 1928 - protein, 20 aa, Artificial
  Short Peptide
RWKKLKKIPPPKFKHSALKF

SEQ ID NO: 1929 - protein, 20 aa, Artificial
  Short Peptide
FWKKLKKIPPPKFKHSALKF

SEQ ID NO: 1930 - protein, 19 aa, Artificial
  Short Peptide
KKKLFLKIPPKFKHSALKF

SEQ ID NO: 1931 - protein, 19 aa, Artificial
  Short Peptide
RKKLFLKIPPKFKHSALKF

SEQ ID NO: 1932 - protein, 19 aa, Artificial
  Short Peptide
FKKLFLKIPPKFKHSALKF

SEQ ID NO: 1933 - protein, 19 aa, Artificial
  Short Peptide
KWKLFLKIPPKFKHSALKF

SEQ ID NO: 1934 - protein, 19 aa, Artificial
  Short Peptide
RWKLFLKIPPKFKHSALKF

SEQ ID NO: 1935 - protein, 19 aa, Artificial
  Short Peptide
FWKLFLKIPPKFKHSALKF

SEQ ID NO: 1936 - protein, 19 aa, Artificial
  Short Peptide
KKKKFLKIPPKFKHSALKF

SEQ ID NO: 1937 - protein, 19 aa, Artificial
  Short Peptide
RKKKFLKIPPKFKHSALKF

SEQ ID NO: 1938 - protein, 19 aa, Artificial
  Short Peptide
FKKKFLKIPPKFKHSALKF

SEQ ID NO: 1939 - protein, 19 aa, Artificial
  Short Peptide
KWKKFLKIPPKFKHSALKF

SEQ ID NO: 1940 - protein, 19 aa, Artificial
  Short Peptide
RWKKFLKIPPKFKHSALKF

SEQ ID NO: 1941 - protein, 19 aa, Artificial
  Short Peptide
FWKKFLKIPPKFKHSALKF

SEQ ID NO: 1942 - protein, 19 aa, Artificial
  Short Peptide
KKKLLLKIPPKFKHSALKF

SEQ ID NO: 1943 - protein, 19 aa, Artificial
  Short Peptide
RKKLLLKIPPKFKHSALKF

SEQ ID NO: 1944 - protein, 19 aa, Artificial
  Short Peptide
FKKLLLKIPPKFKHSALKF

SEQ ID NO: 1945 - protein, 19 aa, Artificial
  Short Peptide
KWKLLLKIPPKFKHSALKF

SEQ ID NO: 1946 - protein, 19 aa, Artificial
  Short Peptide
RWKLLLKIPPKFKHSALKF

SEQ ID NO: 1947 - protein, 19 aa, Artificial
  Short Peptide
FWKLLLKIPPKFKHSALKF

SEQ ID NO: 1948 - protein, 19 aa, Artificial
  Short Peptide
KKKKLLKIPPKFKHSALKF

SEQ ID NO: 1949 - protein, 19 aa, Artificial
  Short Peptide
RKKKLLKIPPKFKHSALKF

SEQ ID NO: 1950 - protein, 19 aa, Artificial
  Short Peptide
FKKKLLKIPPKFKHSALKF

SEQ ID NO: 1951 - protein, 19 aa, Artificial
  Short Peptide
KWKKLLKIPPKFKHSALKF

SEQ ID NO: 1952 - protein, 19 aa, Artificial
  Short Peptide
RWKKLLKIPPKFKHSALKF

SEQ ID NO: 1953 - protein, 19 aa, Artificial
  Short Peptide
FWKKLLKIPPKFKHSALKF

SEQ ID NO: 1954 - protein, 19 aa, Artificial
  Short Peptide
KKKLFKKIPPKFKHSALKF

SEQ ID NO: 1955 - protein, 19 aa, Artificial
  Short Peptide
RKKLFKKIPPKFKHSALKF

SEQ ID NO: 1956 - protein, 19 aa, Artificial
  Short Peptide
FKKLFKKIPPKFKHSALKF

SEQ ID NO: 1957 - protein, 19 aa, Artificial
  Short Peptide
KWKLFKKIPPKFKHSALKF

SEQ ID NO: 1958 - protein, 19 aa, Artificial
  Short Peptide
RWKLFKKIPPKFKHSALKF

SEQ ID NO: 1959 - protein, 19 aa, Artificial
  Short Peptide
FWKLFKKIPPKFKHSALKF

SEQ ID NO: 1960 - protein, 19 aa, Artificial
  Short Peptide
KKKKFKKIPPKFKHSALKF

SEQ ID NO: 1961 - protein, 19 aa, Artificial
  Short Peptide
RKKKFKKIPPKFKHSALKF

SEQ ID NO: 1962 - protein, 19 aa, Artificial
  Short Peptide
FKKKFKKIPPKFKHSALKF

SEQ ID NO: 1963 - protein, 19 aa, Artificial
  Short Peptide
KWKKFKKIPPKFKHSALKF

SEQ ID NO: 1964 - protein, 19 aa, Artificial
  Short Peptide
RWKKFKKIPPKFKHSALKF

SEQ ID NO: 1965 - protein, 19 aa, Artificial
  Short Peptide
FWKKFKKIPPKFKHSALKF

SEQ ID NO: 1966 - protein, 19 aa, Artificial
  Short Peptide
KKKLLKKIPPKFKHSALKF

SEQ ID NO: 1967 - protein, 19 aa, Artificial
  Short Peptide
RKKLLKKIPPKFKHSALKF

SEQ ID NO: 1968 - protein, 19 aa, Artificial
  Short Peptide
FKKLLKKIPPKFKHSALKF

SEQ ID NO: 1969 - protein, 19 aa, Artificial
  Short Peptide
KWKLLKKIPPKFKHSALKF

SEQ ID NO: 1970 - protein, 19 aa, Artificial
  Short Peptide
RWKLLKKIPPKFKHSALKF

SEQ ID NO: 1971 - protein, 19 aa, Artificial
  Short Peptide
FWKLLKKIPPKFKHSALKF

SEQ ID NO: 1972 - protein, 19 aa, Artificial
  Short Peptide
KKKKLKKIPPKFKHSALKF

SEQ ID NO: 1973 - protein, 19 aa, Artificial
  Short Peptide
RKKKLKKIPPKFKHSALKF

SEQ ID NO: 1974 - protein, 19 aa, Artificial
  Short Peptide
FKKKLKKIPPKFKHSALKF

SEQ ID NO: 1975 - protein, 19 aa, Artificial
  Short Peptide
KWKKLKKIPPKFKHSALKF

SEQ ID NO: 1976 - protein, 19 aa, Artificial
  Short Peptide
RWKKLKKIPPKFKHSALKF

SEQ ID NO: 1977 - protein, 19 aa, Artificial
  Short Peptide
FWKKLKKIPPKFKHSALKF

SEQ ID NO: 1978 - protein, 18 aa, Artificial
  Short Peptide
KKKLFLKIPKFKHSALKF

SEQ ID NO: 1979 - protein, 18 aa, Artificial
  Short Peptide
RKKLFLKIPKFKHSALKF

SEQ ID NO: 1980 - protein, 18 aa, Artificial
  Short Peptide
FKKLFLKIPKFKHSALKF

SEQ ID NO: 1981 - protein, 18 aa, Artificial
  Short Peptide
KWKLFLKIPKFKHSALKF

SEQ ID NO: 1982 - protein, 18 aa, Artificial
  Short Peptide
RWKLFLKIPKFKHSALKF

SEQ ID NO: 1983 - protein, 18 aa, Artificial
  Short Peptide
FWKLFLKIPKFKHSALKF

SEQ ID NO: 1984 - protein, 18 aa, Artificial
  Short Peptide
KKKKFLKIPKFKHSALKF

SEQ ID NO: 1985 - protein, 18 aa, Artificial
  Short Peptide
RKKKFLKIPKFKHSALKF

SEQ ID NO: 1986 - protein, 18 aa, Artificial
  Short Peptide
FKKKFLKIPKFKHSALKF

SEQ ID NO: 1987 - protein, 18 aa, Artificial
  Short Peptide
KWKKFLKIPKFKHSALKF

SEQ ID NO: 1988 - protein, 18 aa, Artificial
  Short Peptide
RWKKFLKIPKFKHSALKF

SEQ ID NO: 1989 - protein, 18 aa, Artificial
  Short Peptide
FWKKFLKIPKFKHSALKF

SEQ ID NO: 1990 - protein, 18 aa, Artificial
  Short Peptide
KKKLLLKIPKFKHSALKF

SEQ ID NO: 1991 - protein, 18 aa, Artificial
  Short Peptide
RKKLLLKIPKFKHSALKF

SEQ ID NO: 1992 - protein, 18 aa, Artificial
  Short Peptide
FKKLLLKIPKFKHSALKF

SEQ ID NO: 1993 - protein, 18 aa, Artificial
  Short Peptide
KWKLLLKIPKFKHSALKF

SEQ ID NO: 1994 - protein, 18 aa, Artificial
  Short Peptide
RWKLLLKIPKFKHSALKF

SEQ ID NO: 1995 - protein, 18 aa, Artificial
  Short Peptide
FWKLLLKIPKFKHSALKF

SEQ ID NO: 1996 - protein, 18 aa, Artificial
  Short Peptide
KKKKLLKIPKFKHSALKF

SEQ ID NO: 1997 - protein, 18 aa, Artificial
  Short Peptide
RKKKLLKIPKFKHSALKF

SEQ ID NO: 1998 - protein, 18 aa, Artificial
  Short Peptide
FKKKLLKIPKFKHSALKF

SEQ ID NO: 1999 - protein, 18 aa, Artificial
  Short Peptide
KWKKLLKIPKFKHSALKF

SEQ ID NO: 2000 - protein, 18 aa, Artificial
  Short Peptide
RWKKLLKIPKFKHSALKF

SEQ ID NO: 2001 - protein, 18 aa, Artificial
  Short Peptide
FWKKLLKIPKFKHSALKF

SEQ ID NO: 2002 - protein, 18 aa, Artificial
  Short Peptide
KKKLFKKIPKFKHSALKF

SEQ ID NO: 2003 - protein, 18 aa, Artificial
  Short Peptide
RKKLFKKIPKFKHSALKF

SEQ ID NO: 2004 - protein, 18 aa, Artificial
  Short Peptide
FKKLFKKIPKFKHSALKF

SEQ ID NO: 2005 - protein, 18 aa, Artificial
  Short Peptide
KWKLFKKIPKFKHSALKF

SEQ ID NO: 2006 - protein, 18 aa, Artificial
  Short Peptide
RWKLFKKIPKFKHSALKF

SEQ ID NO: 2007 - protein, 18 aa, Artificial
  Short Peptide
FWKLFKKIPKFKHSALKF

SEQ ID NO: 2008 - protein, 18 aa, Artificial
  Short Peptide
KKKKFKKIPKFKHSALKF

SEQ ID NO: 2009 - protein, 18 aa, Artificial
  Short Peptide
RKKKFKKIPKFKHSALKF

SEQ ID NO: 2010 - protein, 18 aa, Artificial
  Short Peptide
FKKKFKKIPKFKHSALKF

SEQ ID NO: 2011 - protein, 18 aa, Artificial
  Short Peptide
KWKKFKKIPKFKHSALKF

SEQ ID NO: 2012 - protein, 18 aa, Artificial
  Short Peptide
RWKKFKKIPKFKHSALKF

SEQ ID NO: 2013 - protein, 18 aa, Artificial
  Short Peptide
FWKKFKKIPKFKHSALKF

SEQ ID NO: 2014 - protein, 18 aa, Artificial
  Short Peptide
KKKLLKKIPKFKHSALKF

SEQ ID NO: 2015 - protein, 18 aa, Artificial
  Short Peptide
RKKLLKKIPKFKHSALKF

SEQ ID NO: 2016 - protein, 18 aa, Artificial
  Short Peptide
FKKLLKKIPKFKHSALKF

SEQ ID NO: 2017 - protein, 18 aa, Artificial
  Short Peptide
KWKLLKKIPKFKHSALKF

SEQ ID NO: 2018 - protein, 18 aa, Artificial
  Short Peptide
RWKLLKKIPKFKHSALKF

SEQ ID NO: 2019 - protein, 18 aa, Artificial
  Short Peptide
FWKLLKKIPKFKHSALKF

SEQ ID NO: 2020 - protein, 18 aa, Artificial
  Short Peptide
KKKKLKKIPKFKHSALKF

SEQ ID NO: 2021 - protein, 18 aa, Artificial
  Short Peptide
RKKKLKKIPKFKHSALKF

SEQ ID NO: 2022 - protein, 18 aa, Artificial
  Short Peptide
FKKKLKKIPKFKHSALKF

SEQ ID NO: 2023 - protein, 18 aa, Artificial
  Short Peptide
KWKKLKKIPKFKHSALKF

SEQ ID NO: 2024 - protein, 18 aa, Artificial
  Short Peptide
RWKKLKKIPKFKHSALKF

SEQ ID NO: 2025 - protein, 18 aa, Artificial
  Short Peptide
FWKKLKKIPKFKHSALKF

SEQ ID NO: 2026 - protein, 20 aa, Artificial
  Short Peptide
KKKLFLKIPPPKFLKSALKF

SEQ ID NO: 2027 - protein, 20 aa, Artificial
  Short Peptide
RKKLFLKIPPPKFLKSALKF

SEQ ID NO: 2028 - protein, 20 aa, Artificial
  Short Peptide
FKKLFLKIPPPKFLKSALKF

SEQ ID NO: 2029 - protein, 20 aa, Artificial
  Short Peptide
KWKLFLKIPPPKFLKSALKF

SEQ ID NO: 2030 - protein, 20 aa, Artificial
  Short Peptide
RWKLFLKIPPPKFLKSALKF

SEQ ID NO: 2031 - protein, 20 aa, Artificial
  Short Peptide
FWKLFLKIPPPKFLKSALKF

SEQ ID NO: 2032 - protein, 20 aa, Artificial
  Short Peptide
KKKKFLKIPPPKFLKSALKF

SEQ ID NO: 2033 - protein, 20 aa, Artificial
  Short Peptide
RKKKFLKIPPPKFLKSALKF

SEQ ID NO: 2034 - protein, 20 aa, Artificial
  Short Peptide
FKKKFLKIPPPKFLKSALKF

SEQ ID NO: 2035 - protein, 20 aa, Artificial
  Short Peptide
KWKKFLKIPPPKFLKSALKF

SEQ ID NO: 2036 - protein, 20 aa, Artificial
  Short Peptide
RWKKFLKIPPPKFLKSALKF

SEQ ID NO: 2037 - protein, 20 aa, Artificial
  Short Peptide
FWKKFLKIPPPKFLKSALKF

SEQ ID NO: 2038 - protein, 20 aa, Artificial
  Short Peptide
KKKLLLKIPPPKFLKSALKF

SEQ ID NO: 2039 - protein, 20 aa, Artificial
  Short Peptide
RKKLLLKIPPPKFLKSALKF

SEQ ID NO: 2040 - protein, 20 aa, Artificial
  Short Peptide
FKKLLLKIPPPKFLKSALKF

SEQ ID NO: 2041 - protein, 20 aa, Artificial
  Short Peptide
KWKLLLKIPPPKFLKSALKF

SEQ ID NO: 2042 - protein, 20 aa, Artificial
  Short Peptide
RWKLLLKIPPPKFLKSALKF

SEQ ID NO: 2043 - protein, 20 aa, Artificial
  Short Peptide
FWKLLLKIPPPKFLKSALKF

SEQ ID NO: 2044 - protein, 20 aa, Artificial
  Short Peptide
KKKKLLKIPPPKFLKSALKF

SEQ ID NO: 2045 - protein, 20 aa, Artificial
  Short Peptide
RKKKLLKIPPPKFLKSALKF

SEQ ID NO: 2046 - protein, 20 aa, Artificial
  Short Peptide
FKKKLLKIPPPKFLKSALKF

SEQ ID NO: 2047 - protein, 20 aa, Artificial
  Short Peptide
KWKKLLKIPPPKFLKSALKF

SEQ ID NO: 2048 - protein, 20 aa, Artificial
  Short Peptide
RWKKLLKIPPPKFLKSALKF

SEQ ID NO: 2049 - protein, 20 aa, Artificial
  Short Peptide
FWKKLLKIPPPKFLKSALKF

SEQ ID NO: 2050 - protein, 20 aa, Artificial
  Short Peptide
KKKLFKKIPPPKFLKSALKF

SEQ ID NO: 2051 - protein, 20 aa, Artificial
  Short Peptide
RKKLFKKIPPPKFLKSALKF

SEQ ID NO: 2052 - protein, 20 aa, Artificial
  Short Peptide
FKKLFKKIPPPKFLKSALKF

SEQ ID NO: 2053 - protein, 20 aa, Artificial
  Short Peptide
KWKLFKKIPPPKFLKSALKF

SEQ ID NO: 2054 - protein, 20 aa, Artificial
  Short Peptide
RWKLFKKIPPPKFLKSALKF

SEQ ID NO: 2055 - protein, 20 aa, Artificial
  Short Peptide
FWKLFKKIPPPKFLKSALKF

SEQ ID NO: 2056 - protein, 20 aa, Artificial
  Short Peptide
KKKKFKKIPPPKFLKSALKF

SEQ ID NO: 2057 - protein, 20 aa, Artificial
  Short Peptide
RKKKFKKIPPPKFLKSALKF

SEQ ID NO: 2058 - protein, 20 aa, Artificial
  Short Peptide
FKKKFKKIPPPKFLKSALKF

SEQ ID NO: 2059 - protein, 20 aa, Artificial
  Short Peptide
KWKKFKKIPPPKFLKSALKF

SEQ ID NO: 2060 - protein, 20 aa, Artificial
  Short Peptide
RWKKFKKIPPPKFLKSALKF

SEQ ID NO: 2061 - protein, 20 aa, Artificial
  Short Peptide
FWKKFKKIPPPKFLKSALKF

SEQ ID NO: 2062 - protein, 20 aa, Artificial
  Short Peptide
KKKLLKKIPPPKFLKSALKF

SEQ ID NO: 2063 - protein, 20 aa, Artificial
  Short Peptide
RKKLLKKIPPPKFLKSALKF

SEQ ID NO: 2064 - protein, 20 aa, Artificial
  Short Peptide
FKKLLKKIPPPKFLKSALKF

SEQ ID NO: 2065 - protein, 20 aa, Artificial
  Short Peptide
KWKLLKKIPPPKFLKSALKF

SEQ ID NO: 2066 - protein, 20 aa, Artificial
  Short Peptide
RWKLLKKIPPPKFLKSALKF

SEQ ID NO: 2067 - protein, 20 aa, Artificial
  Short Peptide
FWKLLKKIPPPKFLKSALKF

SEQ ID NO: 2068 - protein, 20 aa, Artificial
  Short Peptide
KKKKLKKIPPPKFLKSALKF

SEQ ID NO: 2069 - protein, 20 aa, Artificial
  Short Peptide
RKKKLKKIPPPKFLKSALKF

SEQ ID NO: 2070 - protein, 20 aa, Artificial
  Short Peptide
FKKKLKKIPPPKFLKSALKF

SEQ ID NO: 2071 - protein, 20 aa, Artificial
  Short Peptide
KWKKLKKIPPPKFLKSALKF

SEQ ID NO: 2072 - protein, 20 aa, Artificial
  Short Peptide
RWKKLKKIPPPKFLKSALKF

SEQ ID NO: 2073 - protein, 20 aa, Artificial
  Short Peptide
FWKKLKKIPPPKFLKSALKF

SEQ ID NO: 2074 - protein, 19 aa, Artificial
  Short Peptide
KKKLFLKIPPKFLKSALKF

SEQ ID NO: 2075 - protein, 19 aa, Artificial
  Short Peptide
RKKLFLKIPPKFLKSALKF

SEQ ID NO: 2076 - protein, 19 aa, Artificial
  Short Peptide
FKKLFLKIPPKFLKSALKF

SEQ ID NO: 2077 - protein, 19 aa, Artificial
  Short Peptide
KWKLFLKIPPKFLKSALKF

SEQ ID NO: 2078 - protein, 19 aa, Artificial
  Short Peptide
RWKLFLKIPPKFLKSALKF

SEQ ID NO: 2079 - protein, 19 aa, Artificial
  Short Peptide
FWKLFLKIPPKFLKSALKF

SEQ ID NO: 2080 - protein, 19 aa, Artificial
  Short Peptide
KKKKFLKIPPKFLKSALKF

SEQ ID NO: 2081 - protein, 19 aa, Artificial
  Short Peptide
RKKKFLKIPPKFLKSALKF

SEQ ID NO: 2082 - protein, 19 aa, Artificial
  Short Peptide
FKKKFLKIPPKFLKSALKF

SEQ ID NO: 2083 - protein, 19 aa, Artificial
  Short Peptide
KWKKFLKIPPKFLKSALKF

SEQ ID NO: 2084 - protein, 19 aa, Artificial
  Short Peptide
RWKKFLKIPPKFLKSALKF

SEQ ID NO: 2085 - protein, 19 aa, Artificial
  Short Peptide
FWKKFLKIPPKFLKSALKF

SEQ ID NO: 2086 - protein, 19 aa, Artificial
  Short Peptide
KKKLLLKIPPKFLKSALKF

SEQ ID NO: 2087 - protein, 19 aa, Artificial
  Short Peptide
RKKLLLKIPPKFLKSALKF

SEQ ID NO: 2088 - protein, 19 aa, Artificial
  Short Peptide
FKKLLLKIPPKFLKSALKF

SEQ ID NO: 2089 - protein, 19 aa, Artificial
  Short Peptide
KWKLLLKIPPKFLKSALKF

SEQ ID NO: 2090 - protein, 19 aa, Artificial
  Short Peptide
RWKLLLKIPPKFLKSALKF

SEQ ID NO: 2091 - protein, 19 aa, Artificial
  Short Peptide
FWKLLLKIPPKFLKSALKF

SEQ ID NO: 2092 - protein, 19 aa, Artificial
  Short Peptide
KKKKLLKIPPKFLKSALKF

SEQ ID NO: 2093 - protein, 19 aa, Artificial
  Short Peptide
RKKKLLKIPPKFLKSALKF

SEQ ID NO: 2094 - protein, 19 aa, Artificial
  Short Peptide
FKKKLLKIPPKFLKSALKF

SEQ ID NO: 2095 - protein, 19 aa, Artificial
  Short Peptide
KWKKLLKIPPKFLKSALKF

SEQ ID NO: 2096 - protein, 19 aa, Artificial
  Short Peptide
RWKKLLKIPPKFLKSALKF

SEQ ID NO: 2097 - protein, 19 aa, Artificial
  Short Peptide
FWKKLLKIPPKFLKSALKF

SEQ ID NO: 2098 - protein, 19 aa, Artificial
  Short Peptide
KKKLFKKIPPKFLKSALKF

SEQ ID NO: 2099 - protein, 19 aa, Artificial
  Short Peptide
RKKLFKKIPPKFLKSALKF

SEQ ID NO: 2100 - protein, 19 aa, Artificial
  Short Peptide
FKKLFKKIPPKFLKSALKF

SEQ ID NO: 2101 - protein, 19 aa, Artificial
  Short Peptide
KWKLFKKIPPKFLKSALKF

SEQ ID NO: 2102 - protein, 19 aa, Artificial
  Short Peptide
RWKLFKKIPPKFLKSALKF

SEQ ID NO: 2103 - protein, 19 aa, Artificial
  Short Peptide
FWKLFKKIPPKFLKSALKF

SEQ ID NO: 2104 - protein, 19 aa, Artificial
  Short Peptide
KKKKFKKIPPKFLKSALKF

SEQ ID NO: 2105 - protein, 19 aa, Artificial
  Short Peptide
RKKKFKKIPPKFLKSALKF

SEQ ID NO: 2106 - protein, 19 aa, Artificial
  Short Peptide
FKKKFKKIPPKFLKSALKF

SEQ ID NO: 2107 - protein, 19 aa, Artificial
  Short Peptide
KWKKFKKIPPKFLKSALKF

SEQ ID NO: 2108 - protein, 19 aa, Artificial
  Short Peptide
RWKKFKKIPPKFLKSALKF

SEQ ID NO: 2109 - protein, 19 aa, Artificial
  Short Peptide
FWKKFKKIPPKFLKSALKF

SEQ ID NO: 2110 - protein, 19 aa, Artificial
  Short Peptide
KKKLLKKIPPKFLKSALKF

SEQ ID NO: 2111 - protein, 19 aa, Artificial
  Short Peptide
RKKLLKKIPPKFLKSALKF

SEQ ID NO: 2112 - protein, 19 aa, Artificial
  Short Peptide
FKKLLKKIPPKFLKSALKF

SEQ ID NO: 2113 - protein, 19 aa, Artificial
  Short Peptide
KWKLLKKIPPKFLKSALKF

SEQ ID NO: 2114 - protein, 19 aa, Artificial
  Short Peptide
RWKLLKKIPPKFLKSALKF

SEQ ID NO: 2115 - protein, 19 aa, Artificial
  Short Peptide
FWKLLKKIPPKFLKSALKF

SEQ ID NO: 2116 - protein, 19 aa, Artificial
  Short Peptide
KKKKLKKIPPKFLKSALKF

SEQ ID NO: 2117 - protein, 19 aa, Artificial
  Short Peptide
RKKKLKKIPPKFLKSALKF

SEQ ID NO: 2118 - protein, 19 aa, Artificial
  Short Peptide
FKKKLKKIPPKFLKSALKF

SEQ ID NO: 2119 - protein, 19 aa, Artificial
  Short Peptide
KWKKLKKIPPKFLKSALKF

SEQ ID NO: 2120 - protein, 19 aa, Artificial
  Short Peptide
RWKKLKKIPPKFLKSALKF

SEQ ID NO: 2121 - protein, 19 aa, Artificial
  Short Peptide
FWKKLKKIPPKFLKSALKF

SEQ ID NO: 2122 - protein, 18 aa, Artificial
  Short Peptide
KKKLFLKIPKFLKSALKF

SEQ ID NO: 2123 - protein, 18 aa, Artificial
  Short Peptide
RKKLFLKIPKFLKSALKF

SEQ ID NO: 2124 - protein, 18 aa, Artificial
  Short Peptide
FKKLFLKIPKFLKSALKF

SEQ ID NO: 2125 - protein, 18 aa, Artificial
  Short Peptide
KWKLFLKIPKFLKSALKF

SEQ ID NO: 2126 - protein, 18 aa, Artificial
  Short Peptide
RWKLFLKIPKFLKSALKF

SEQ ID NO: 2127 - protein, 18 aa, Artificial
  Short Peptide
FWKLFLKIPKFLKSALKF

SEQ ID NO: 2128 - protein, 18 aa, Artificial
  Short Peptide
KKKKFLKIPKFLKSALKF

SEQ ID NO: 2129 - protein, 18 aa, Artificial
  Short Peptide
RKKKFLKIPKFLKSALKF

SEQ ID NO: 2130 - protein, 18 aa, Artificial
  Short Peptide
FKKKFLKIPKFLKSALKF

SEQ ID NO: 2131 - protein, 18 aa, Artificial
  Short Peptide
KWKKFLKIPKFLKSALKF

SEQ ID NO: 2132 - protein, 18 aa, Artificial
  Short Peptide
RWKKFLKIPKFLKSALKF

SEQ ID NO: 2133 - protein, 18 aa, Artificial
  Short Peptide
FWKKFLKIPKFLKSALKF

SEQ ID NO: 2134 - protein, 18 aa, Artificial
  Short Peptide
KKKLLLKIPKFLKSALKF

SEQ ID NO: 2135 - protein, 18 aa, Artificial
  Short Peptide
RKKLLLKIPKFLKSALKF

SEQ ID NO: 2136 - protein, 18 aa, Artificial
  Short Peptide
FKKLLLKIPKFLKSALKF

SEQ ID NO: 2137 - protein, 18 aa, Artificial
  Short Peptide
KWKLLLKIPKFLKSALKF

SEQ ID NO: 2138 - protein, 18 aa, Artificial
  Short Peptide
RWKLLLKIPKFLKSALKF

SEQ ID NO: 2139 - protein, 18 aa, Artificial
  Short Peptide
FWKLLLKIPKFLKSALKF

SEQ ID NO: 2140 - protein, 18 aa, Artificial
  Short Peptide
KKKKLLKIPKFLKSALKF

SEQ ID NO: 2141 - protein, 18 aa, Artificial
  Short Peptide
RKKKLLKIPKFLKSALKF

SEQ ID NO: 2142 - protein, 18 aa, Artificial
  Short Peptide
FKKKLLKIPKFLKSALKF

SEQ ID NO: 2143 - protein, 18 aa, Artificial
  Short Peptide
KWKKLLKIPKFLKSALKF

SEQ ID NO: 2144 - protein, 18 aa, Artificial
  Short Peptide
RWKKLLKIPKFLKSALKF

SEQ ID NO: 2145 - protein, 18 aa, Artificial
  Short Peptide
FWKKLLKIPKFLKSALKF

SEQ ID NO: 2146 - protein, 18 aa, Artificial
  Short Peptide
KKKLFKKIPKFLKSALKF

SEQ ID NO: 2147 - protein, 18 aa, Artificial
  Short Peptide
RKKLFKKIPKFLKSALKF

SEQ ID NO: 2148 - protein, 18 aa, Artificial
  Short Peptide
FKKLFKKIPKFLKSALKF

SEQ ID NO: 2149 - protein, 18 aa, Artificial
  Short Peptide
KWKLFKKIPKFLKSALKF

SEQ ID NO: 2150 - protein, 18 aa, Artificial
  Short Peptide
RWKLFKKIPKFLKSALKF

SEQ ID NO: 2151 - protein, 18 aa, Artificial
  Short Peptide
FWKLFKKIPKFLKSALKF

SEQ ID NO: 2152 - protein, 18 aa, Artificial
  Short Peptide
KKKKFKKIPKFLKSALKF

SEQ ID NO: 2153 - protein, 18 aa, Artificial
  Short Peptide
RKKKFKKIPKFLKSALKF

SEQ ID NO: 2154 - protein, 18 aa, Artificial
  Short Peptide
FKKKFKKIPKFLKSALKF

SEQ ID NO: 2155 - protein, 18 aa, Artificial
  Short Peptide
KWKKFKKIPKFLKSALKF

SEQ ID NO: 2156 - protein, 18 aa, Artificial
  Short Peptide
RWKKFKKIPKFLKSALKF

SEQ ID NO: 2157 - protein, 18 aa, Artificial
  Short Peptide
FWKKFKKIPKFLKSALKF

SEQ ID NO: 2158 - protein, 18 aa, Artificial
  Short Peptide
KKKLLKKIPKFLKSALKF

SEQ ID NO: 2159 - protein, 18 aa, Artificial
  Short Peptide
RKKLLKKIPKFLKSALKF

SEQ ID NO: 2160 - protein, 18 aa, Artificial
  Short Peptide
FKKLLKKIPKFLKSALKF

SEQ ID NO: 2161 - protein, 18 aa, Artificial
  Short Peptide
KWKLLKKIPKFLKSALKF

SEQ ID NO: 2162 - protein, 18 aa, Artificial
  Short Peptide
RWKLLKKIPKFLKSALKF

SEQ ID NO: 2163 - protein, 18 aa, Artificial
  Short Peptide
FWKLLKKIPKFLKSALKF

SEQ ID NO: 2164 - protein, 18 aa, Artificial
  Short Peptide
KKKKLKKIPKFLKSALKF

SEQ ID NO: 2165 - protein, 18 aa, Artificial
  Short Peptide
RKKKLKKIPKFLKSALKF

SEQ ID NO: 2166 - protein, 18 aa, Artificial
  Short Peptide
FKKKLKKIPKFLKSALKF

SEQ ID NO: 2167 - protein, 18 aa, Artificial
  Short Peptide
KWKKLKKIPKFLKSALKF

SEQ ID NO: 2168 - protein, 18 aa, Artificial
  Short Peptide
RWKKLKKIPKFLKSALKF

SEQ ID NO: 2169 - protein, 18 aa, Artificial
  Short Peptide
FWKKLKKIPKFLKSALKF

SEQ ID NO: 2170 - protein, 20 aa, Artificial
  Short Peptide
KKKLFLKIPPPKFKKSALKF

SEQ ID NO: 2171 - protein, 20 aa, Artificial
  Short Peptide
RKKLFLKIPPPKFKKSALKF

SEQ ID NO: 2172 - protein, 20 aa, Artificial
  Short Peptide
FKKLFLKIPPPKFKKSALKF

SEQ ID NO: 2173 - protein, 20 aa, Artificial
  Short Peptide
KWKLFLKIPPPKFKKSALKF

SEQ ID NO: 2174 - protein, 20 aa, Artificial
  Short Peptide
RWKLFLKIPPPKFKKSALKF

SEQ ID NO: 2175 - protein, 20 aa, Artificial
  Short Peptide
FWKLFLKIPPPKFKKSALKF

SEQ ID NO: 2176 - protein, 20 aa, Artificial
  Short Peptide
KKKKFLKIPPPKFKKSALKF

SEQ ID NO: 2177 - protein, 20 aa, Artificial
  Short Peptide
RKKKFLKIPPPKFKKSALKF

SEQ ID NO: 2178 - protein, 20 aa, Artificial
  Short Peptide
FKKKFLKIPPPKFKKSALKF

SEQ ID NO: 2179 - protein, 20 aa, Artificial
  Short Peptide
KWKKFLKIPPPKFKKSALKF

SEQ ID NO: 2180 - protein, 20 aa, Artificial
  Short Peptide
RWKKFLKIPPPKFKKSALKF

SEQ ID NO: 2181 - protein, 20 aa, Artificial
  Short Peptide
FWKKFLKIPPPKFKKSALKF

SEQ ID NO: 2182 - protein, 20 aa, Artificial
  Short Peptide
KKKLLLKIPPPKFKKSALKF

SEQ ID NO: 2183 - protein, 20 aa, Artificial
  Short Peptide
RKKLLLKIPPPKFKKSALKF

SEQ ID NO: 2184 - protein, 20 aa, Artificial
  Short Peptide
FKKLLLKIPPPKFKKSALKF

SEQ ID NO: 2185 - protein, 20 aa, Artificial
  Short Peptide
KWKLLLKIPPPKFKKSALKF

SEQ ID NO: 2186 - protein, 20 aa, Artificial
  Short Peptide
RWKLLLKIPPPKFKKSALKF

SEQ ID NO: 2187 - protein, 20 aa, Artificial
  Short Peptide
FWKLLLKIPPPKFKKSALKF

SEQ ID NO: 2188 - protein, 20 aa, Artificial
  Short Peptide
KKKKLLKIPPPKFKKSALKF

SEQ ID NO: 2189 - protein, 20 aa, Artificial
  Short Peptide
RKKKLLKIPPPKFKKSALKF

SEQ ID NO: 2190 - protein, 20 aa, Artificial
  Short Peptide
FKKKLLKIPPPKFKKSALKF

SEQ ID NO: 2191 - protein, 20 aa, Artificial
  Short Peptide
KWKKLLKIPPPKFKKSALKF

SEQ ID NO: 2192 - protein, 20 aa, Artificial
  Short Peptide
RWKKLLKIPPPKFKKSALKF

SEQ ID NO: 2193 - protein, 20 aa, Artificial
  Short Peptide
FWKKLLKIPPPKFKKSALKF

SEQ ID NO: 2194 - protein, 20 aa, Artificial
  Short Peptide
KKKLFKKIPPPKFKKSALKF

SEQ ID NO: 2195 - protein, 20 aa, Artificial
  Short Peptide
RKKLFKKIPPPKFKKSALKF

SEQ ID NO: 2196 - protein, 20 aa, Artificial
  Short Peptide
FKKLFKKIPPPKFKKSALKF

SEQ ID NO: 2197 - protein, 20 aa, Artificial
  Short Peptide
KWKLFKKIPPPKFKKSALKF

SEQ ID NO: 2198 - protein, 20 aa, Artificial
  Short Peptide
RWKLFKKIPPPKFKKSALKF

SEQ ID NO: 2199 - protein, 20 aa, Artificial
  Short Peptide
FWKLFKKIPPPKFKKSALKF

SEQ ID NO: 2200 - protein, 20 aa, Artificial
  Short Peptide
KKKKFKKIPPPKFKKSALKF

SEQ ID NO: 2201 - protein, 20 aa, Artificial
  Short Peptide
RKKKFKKIPPPKFKKSALKF

SEQ ID NO: 2202 - protein, 20 aa, Artificial
  Short Peptide
FKKKFKKIPPPKFKKSALKF

SEQ ID NO: 2203 - protein, 20 aa, Artificial
  Short Peptide
KWKKFKKIPPPKFKKSALKF

SEQ ID NO: 2204 - protein, 20 aa, Artificial
  Short Peptide
RWKKFKKIPPPKFKKSALKF

SEQ ID NO: 2205 - protein, 20 aa, Artificial
  Short Peptide
FWKKFKKIPPPKFKKSALKF

SEQ ID NO: 2206 - protein, 20 aa, Artificial
  Short Peptide
KKKLLKKIPPPKFKKSALKF

SEQ ID NO: 2207 - protein, 20 aa, Artificial
  Short Peptide
RKKLLKKIPPPKFKKSALKF

SEQ ID NO: 2208 - protein, 20 aa, Artificial
  Short Peptide
FKKLLKKIPPPKFKKSALKF

SEQ ID NO: 2209 - protein, 20 aa, Artificial
  Short Peptide
KWKLLKKIPPPKFKKSALKF

SEQ ID NO: 2210 - protein, 20 aa, Artificial
  Short Peptide
RWKLLKKIPPPKFKKSALKF

SEQ ID NO: 2211 - protein, 20 aa, Artificial
  Short Peptide
FWKLLKKIPPPKFKKSALKF

SEQ ID NO: 2212 - protein, 20 aa, Artificial
  Short Peptide
KKKKLKKIPPPKFKKSALKF

SEQ ID NO: 2213 - protein, 20 aa, Artificial
  Short Peptide
RKKKLKKIPPPKFKKSALKF

SEQ ID NO: 2214 - protein, 20 aa, Artificial
  Short Peptide
FKKKLKKIPPPKFKKSALKF

SEQ ID NO: 2215 - protein, 20 aa, Artificial
  Short Peptide
KWKKLKKIPPPKFKKSALKF

SEQ ID NO: 2216 - protein, 20 aa, Artificial
  Short Peptide
RWKKLKKIPPPKFKKSALKF

SEQ ID NO: 2217 - protein, 20 aa, Artificial
  Short Peptide
FWKKLKKIPPPKFKKSALKF

SEQ ID NO: 2218 - protein, 19 aa, Artificial
  Short Peptide
KKKLFLKIPPKFKKSALKF

SEQ ID NO: 2219 - protein, 19 aa, Artificial
  Short Peptide
RKKLFLKIPPKFKKSALKF

SEQ ID NO: 2220 - protein, 19 aa, Artificial
  Short Peptide
FKKLFLKIPPKFKKSALKF

SEQ ID NO: 2221 - protein, 19 aa, Artificial
  Short Peptide
KWKLFLKIPPKFKKSALKF

SEQ ID NO: 2222 - protein, 19 aa, Artificial
  Short Peptide
RWKLFLKIPPKFKKSALKF

SEQ ID NO: 2223 - protein, 19 aa, Artificial
  Short Peptide
FWKLFLKIPPKFKKSALKF

SEQ ID NO: 2224 - protein, 19 aa, Artificial
  Short Peptide
KKKKFLKIPPKFKKSALKF

SEQ ID NO: 2225 - protein, 19 aa, Artificial
  Short Peptide
RKKKFLKIPPKFKKSALKF

SEQ ID NO: 2226 - protein, 19 aa, Artificial
  Short Peptide
FKKKFLKIPPKFKKSALKF

SEQ ID NO: 2227 - protein, 19 aa, Artificial
  Short Peptide
KWKKFLKIPPKFKKSALKF

SEQ ID NO: 2228 - protein, 19 aa, Artificial
  Short Peptide
RWKKFLKIPPKFKKSALKF

SEQ ID NO: 2229 - protein, 19 aa, Artificial
  Short Peptide
FWKKFLKIPPKFKKSALKF

SEQ ID NO: 2230 - protein, 19 aa, Artificial
  Short Peptide
KKKLLLKIPPKFKKSALKF

SEQ ID NO: 2231 - protein, 19 aa, Artificial
  Short Peptide
RKKLLLKIPPKFKKSALKF

SEQ ID NO: 2232 - protein, 19 aa, Artificial
  Short Peptide
FKKLLLKIPPKFKKSALKF

SEQ ID NO: 2233 - protein, 19 aa, Artificial
  Short Peptide
KWKLLLKIPPKFKKSALKF

SEQ ID NO: 2234 - protein, 19 aa, Artificial
  Short Peptide
RWKLLLKIPPKFKKSALKF

SEQ ID NO: 2235 - protein, 19 aa, Artificial
  Short Peptide
FWKLLLKIPPKFKKSALKF

SEQ ID NO: 2236 - protein, 19 aa, Artificial
  Short Peptide
KKKKLLKIPPKFKKSALKF

SEQ ID NO: 2237 - protein, 19 aa, Artificial
  Short Peptide
RKKKLLKIPPKFKKSALKF

SEQ ID NO: 2238 - protein, 19 aa, Artificial
  Short Peptide
FKKKLLKIPPKFKKSALKF

SEQ ID NO: 2239 - protein, 19 aa, Artificial
  Short Peptide
KWKKLLKIPPKFKKSALKF

SEQ ID NO: 2240 - protein, 19 aa, Artificial
  Short Peptide
RWKKLLKIPPKFKKSALKF

SEQ ID NO: 2241 - protein, 19 aa, Artificial
  Short Peptide
FWKKLLKIPPKFKKSALKF

SEQ ID NO: 2242 - protein, 19 aa, Artificial
  Short Peptide
KKKLFKKIPPKFKKSALKF

SEQ ID NO: 2243 - protein, 19 aa, Artificial
  Short Peptide
RKKLFKKIPPKFKKSALKF

SEQ ID NO: 2244 - protein, 19 aa, Artificial
  Short Peptide
FKKLFKKIPPKFKKSALKF

SEQ ID NO: 2245 - protein, 19 aa, Artificial
  Short Peptide
KWKLFKKIPPKFKKSALKF

SEQ ID NO: 2246 - protein, 19 aa, Artificial
  Short Peptide
RWKLFKKIPPKFKKSALKF

SEQ ID NO: 2247 - protein, 19 aa, Artificial
  Short Peptide
FWKLFKKIPPKFKKSALKF

SEQ ID NO: 2248 - protein, 19 aa, Artificial
  Short Peptide
KKKKFKKIPPKFKKSALKF

SEQ ID NO: 2249 - protein, 19 aa, Artificial
  Short Peptide
RKKKFKKIPPKFKKSALKF

SEQ ID NO: 2250 - protein, 19 aa, Artificial
  Short Peptide
FKKKFKKIPPKFKKSALKF

SEQ ID NO: 2251 - protein, 19 aa, Artificial
  Short Peptide
KWKKFKKIPPKFKKSALKF

SEQ ID NO: 2252 - protein, 19 aa, Artificial
  Short Peptide
RWKKFKKIPPKFKKSALKF

SEQ ID NO: 2253 - protein, 19 aa, Artificial
  Short Peptide
FWKKFKKIPPKFKKSALKF

SEQ ID NO: 2254 - protein, 19 aa, Artificial
  Short Peptide
KKKLLKKIPPKFKKSALKF

SEQ ID NO: 2255 - protein, 19 aa, Artificial
  Short Peptide
RKKLLKKIPPKFKKSALKF

SEQ ID NO: 2256 - protein, 19 aa, Artificial
  Short Peptide
FKKLLKKIPPKFKKSALKF

SEQ ID NO: 2257 - protein, 19 aa, Artificial
  Short Peptide
KWKLLKKIPPKFKKSALKF

SEQ ID NO: 2258 - protein, 19 aa, Artificial
  Short Peptide
RWKLLKKIPPKFKKSALKF

SEQ ID NO: 2259 - protein, 19 aa, Artificial
  Short Peptide
FWKLLKKIPPKFKKSALKF

SEQ ID NO: 2260 - protein, 19 aa, Artificial
  Short Peptide
KKKKLKKIPPKFKKSALKF

SEQ ID NO: 2261 - protein, 19 aa, Artificial
  Short Peptide
RKKKLKKIPPKFKKSALKF

SEQ ID NO: 2262 - protein, 19 aa, Artificial
  Short Peptide
FKKKLKKIPPKFKKSALKF

SEQ ID NO: 2263 - protein, 19 aa, Artificial
  Short Peptide
KWKKLKKIPPKFKKSALKF

SEQ ID NO: 2264 - protein, 19 aa, Artificial
  Short Peptide
RWKKLKKIPPKFKKSALKF

SEQ ID NO: 2265 - protein, 19 aa, Artificial
  Short Peptide
FWKKLKKIPPKFKKSALKF

SEQ ID NO: 2266 - protein, 18 aa, Artificial
  Short Peptide
KKKLFLKIPKFKKSALKF

SEQ ID NO: 2267 - protein, 18 aa, Artificial
  Short Peptide
RKKLFLKIPKFKKSALKF

SEQ ID NO: 2268 - protein, 18 aa, Artificial
  Short Peptide
FKKLFLKIPKFKKSALKF

SEQ ID NO: 2269 - protein, 18 aa, Artificial
  Short Peptide
KWKLFLKIPKFKKSALKF

SEQ ID NO: 2270 - protein, 18 aa, Artificial
  Short Peptide
RWKLFLKIPKFKKSALKF

SEQ ID NO: 2271 - protein, 18 aa, Artificial
  Short Peptide
FWKLFLKIPKFKKSALKF

SEQ ID NO: 2272 - protein, 18 aa, Artificial
  Short Peptide
KKKKFLKIPKFKKSALKF

SEQ ID NO: 2273 - protein, 18 aa, Artificial
  Short Peptide
RKKKFLKIPKFKKSALKF

SEQ ID NO: 2274 - protein, 18 aa, Artificial
  Short Peptide
FKKKFLKIPKFKKSALKF

SEQ ID NO: 2275 - protein, 18 aa, Artificial
  Short Peptide
KWKKFLKIPKFKKSALKF

SEQ ID NO: 2276 - protein, 18 aa, Artificial
  Short Peptide
RWKKFLKIPKFKKSALKF

SEQ ID NO: 2277 - protein, 18 aa, Artificial
  Short Peptide
FWKKFLKIPKFKKSALKF

SEQ ID NO: 2278 - protein, 18 aa, Artificial
  Short Peptide
KKKLLLKIPKFKKSALKF

SEQ ID NO: 2279 - protein, 18 aa, Artificial
  Short Peptide
RKKLLLKIPKFKKSALKF

SEQ ID NO: 2280 - protein, 18 aa, Artificial
  Short Peptide
FKKLLLKIPKFKKSALKF

SEQ ID NO: 2281 - protein, 18 aa, Artificial
  Short Peptide
KWKLLLKIPKFKKSALKF

SEQ ID NO: 2282 - protein, 18 aa, Artificial
  Short Peptide
RWKLLLKIPKFKKSALKF

SEQ ID NO: 2283 - protein, 18 aa, Artificial
  Short Peptide
FWKLLLKIPKFKKSALKF

SEQ ID NO: 2284 - protein, 18 aa, Artificial
  Short Peptide
KKKKLLKIPKFKKSALKF

SEQ ID NO: 2285 - protein, 18 aa, Artificial
  Short Peptide
RKKKLLKIPKFKKSALKF

SEQ ID NO: 2286 - protein, 18 aa, Artificial
  Short Peptide
FKKKLLKIPKFKKSALKF

SEQ ID NO: 2287 - protein, 18 aa, Artificial
  Short Peptide
KWKKLLKIPKFKKSALKF

SEQ ID NO: 2288 - protein, 18 aa, Artificial
  Short Peptide
RWKKLLKIPKFKKSALKF

SEQ ID NO: 2289 - protein, 18 aa, Artificial
  Short Peptide
FWKKLLKIPKFKKSALKF

SEQ ID NO: 2290 - protein, 18 aa, Artificial
  Short Peptide
KKKLFKKIPKFKKSALKF

SEQ ID NO: 2291 - protein, 18 aa, Artificial
  Short Peptide
RKKLFKKIPKFKKSALKF

SEQ ID NO: 2292 - protein, 18 aa, Artificial
  Short Peptide
FKKLFKKIPKFKKSALKF

SEQ ID NO: 2293 - protein, 18 aa, Artificial
  Short Peptide
KWKLFKKIPKFKKSALKF

SEQ ID NO: 2294 - protein, 18 aa, Artificial
  Short Peptide
RWKLFKKIPKFKKSALKF

SEQ ID NO: 2295 - protein, 18 aa, Artificial
  Short Peptide
FWKLFKKIPKFKKSALKF

SEQ ID NO: 2296 - protein, 18 aa, Artificial
  Short Peptide
KKKKFKKIPKFKKSALKF

SEQ ID NO: 2297 - protein, 18 aa, Artificial
  Short Peptide
RKKKFKKIPKFKKSALKF

SEQ ID NO: 2298 - protein, 18 aa, Artificial
  Short Peptide
FKKKFKKIPKFKKSALKF

SEQ ID NO: 2299 - protein, 18 aa, Artificial
  Short Peptide
KWKKFKKIPKFKKSALKF

SEQ ID NO: 2300 - protein, 18 aa, Artificial
  Short Peptide
RWKKFKKIPKFKKSALKF

SEQ ID NO: 2301 - protein, 18 aa, Artificial
  Short Peptide
FWKKFKKIPKFKKSALKF

SEQ ID NO: 2302 - protein, 18 aa, Artificial
  Short Peptide
KKKLLKKIPKFKKSALKF

SEQ ID NO: 2303 - protein, 18 aa, Artificial
  Short Peptide
RKKLLKKIPKFKKSALKF

SEQ ID NO: 2304 - protein, 18 aa, Artificial
  Short Peptide
FKKLLKKIPKFKKSALKF

SEQ ID NO: 2305 - protein, 18 aa, Artificial
  Short Peptide
KWKLLKKIPKFKKSALKF

SEQ ID NO: 2306 - protein, 18 aa, Artificial
  Short Peptide
RWKLLKKIPKFKKSALKF

SEQ ID NO: 2307 - protein, 18 aa, Artificial
  Short Peptide
FWKLLKKIPKFKKSALKF

SEQ ID NO: 2308 - protein, 18 aa, Artificial
  Short Peptide
KKKKLKKIPKFKKSALKF

SEQ ID NO: 2309 - protein, 18 aa, Artificial
  Short Peptide
RKKKLKKIPKFKKSALKF

SEQ ID NO: 2310 - protein, 18 aa, Artificial
  Short Peptide
FKKKLKKIPKFKKSALKF

SEQ ID NO: 2311 - protein, 18 aa, Artificial
  Short Peptide
KWKKLKKIPKFKKSALKF

SEQ ID NO: 2312 - protein, 18 aa, Artificial
  Short Peptide
RWKKLKKIPKFKKSALKF

SEQ ID NO: 2313 - protein, 18 aa, Artificial
  Short Peptide
FWKKLKKIPKFKKSALKF

SEQ ID NO: 2314 - protein, 20 aa, Artificial
  Short Peptide
KKKLFLKIPPPKFLHAAKKF

SEQ ID NO: 2315 - protein, 20 aa, Artificial
  Short Peptide
RKKLFLKIPPPKFLHAAKKF

SEQ ID NO: 2316 - protein, 20 aa, Artificial
  Short Peptide
FKKLFLKIPPPKFLHAAKKF

SEQ ID NO: 2317 - protein, 20 aa, Artificial
  Short Peptide
KWKLFLKIPPPKFLHAAKKF

SEQ ID NO: 2318 - protein, 20 aa, Artificial
  Short Peptide
RWKLFLKIPPPKFLHAAKKF

SEQ ID NO: 2319 - protein, 20 aa, Artificial
  Short Peptide
FWKLFLKIPPPKFLHAAKKF

SEQ ID NO: 2320 - protein, 20 aa, Artificial
  Short Peptide
KKKKFLKIPPPKFLHAAKKF

SEQ ID NO: 2321 - protein, 20 aa, Artificial
  Short Peptide
RKKKFLKIPPPKFLHAAKKF

SEQ ID NO: 2322 - protein, 20 aa, Artificial
  Short Peptide
FKKKFLKIPPPKFLHAAKKF

SEQ ID NO: 2323 - protein, 20 aa, Artificial
  Short Peptide
KWKKFLKIPPPKFLHAAKKF

SEQ ID NO: 2324 - protein, 20 aa, Artificial
  Short Peptide
RWKKFLKIPPPKFLHAAKKF

SEQ ID NO: 2325 - protein, 20 aa, Artificial
  Short Peptide
FWKKFLKIPPPKFLHAAKKF

SEQ ID NO: 2326 - protein, 20 aa, Artificial
  Short Peptide
KKKLLLKIPPPKFLHAAKKF

SEQ ID NO: 2327 - protein, 20 aa, Artificial
  Short Peptide
RKKLLLKIPPPKFLHAAKKF

SEQ ID NO: 2328 - protein, 20 aa, Artificial
  Short Peptide
FKKLLLKIPPPKFLHAAKKF

SEQ ID NO: 2329 - protein, 20 aa, Artificial
  Short Peptide
KWKLLLKIPPPKFLHAAKKF

SEQ ID NO: 2330 - protein, 20 aa, Artificial
  Short Peptide
RWKLLLKIPPPKFLHAAKKF

SEQ ID NO: 2331 - protein, 20 aa, Artificial
  Short Peptide
FWKLLLKIPPPKFLHAAKKF

SEQ ID NO: 2332 - protein, 20 aa, Artificial
  Short Peptide
KKKKLLKIPPPKFLHAAKKF

SEQ ID NO: 2333 - protein, 20 aa, Artificial
  Short Peptide
RKKKLLKIPPPKFLHAAKKF

SEQ ID NO: 2334 - protein, 20 aa, Artificial
  Short Peptide
FKKKLLKIPPPKFLHAAKKF

SEQ ID NO: 2335 - protein, 20 aa, Artificial
  Short Peptide
KWKKLLKIPPPKFLHAAKKF

SEQ ID NO: 2336 - protein, 20 aa, Artificial
  Short Peptide
RWKKLLKIPPPKFLHAAKKF

SEQ ID NO: 2337 - protein, 20 aa, Artificial
  Short Peptide
FWKKLLKIPPPKFLHAAKKF

SEQ ID NO: 2338 - protein, 20 aa, Artificial
  Short Peptide
KKKLFKKIPPPKFLHAAKKF

SEQ ID NO: 2339 - protein, 20 aa, Artificial
  Short Peptide
RKKLFKKIPPPKFLHAAKKF

SEQ ID NO: 2340 - protein, 20 aa, Artificial
  Short Peptide
FKKLFKKIPPPKFLHAAKKF

SEQ ID NO: 2341 - protein, 20 aa, Artificial
  Short Peptide
KWKLFKKIPPPKFLHAAKKF

SEQ ID NO: 2342 - protein, 20 aa, Artificial
  Short Peptide
RWKLFKKIPPPKFLHAAKKF

SEQ ID NO: 2343 - protein, 20 aa, Artificial
  Short Peptide
FWKLFKKIPPPKFLHAAKKF

SEQ ID NO: 2344 - protein, 20 aa, Artificial
  Short Peptide
KKKKFKKIPPPKFLHAAKKF

SEQ ID NO: 2345 - protein, 20 aa, Artificial
  Short Peptide
RKKKFKKIPPPKFLHAAKKF

SEQ ID NO: 2346 - protein, 20 aa, Artificial
  Short Peptide
FKKKFKKIPPPKFLHAAKKF

SEQ ID NO: 2347 - protein, 20 aa, Artificial
  Short Peptide
KWKKFKKIPPPKFLHAAKKF

SEQ ID NO: 2348 - protein, 20 aa, Artificial
  Short Peptide
RWKKFKKIPPPKFLHAAKKF

SEQ ID NO: 2349 - protein, 20 aa, Artificial
  Short Peptide
FWKKFKKIPPPKFLHAAKKF

SEQ ID NO: 2350 - protein, 20 aa, Artificial
  Short Peptide
KKKLLKKIPPPKFLHAAKKF

SEQ ID NO: 2351 - protein, 20 aa, Artificial
  Short Peptide
RKKLLKKIPPPKFLHAAKKF

SEQ ID NO: 2352 - protein, 20 aa, Artificial
  Short Peptide
FKKLLKKIPPPKFLHAAKKF

SEQ ID NO: 2353 - protein, 20 aa, Artificial
  Short Peptide
KWKLLKKIPPPKFLHAAKKF

SEQ ID NO: 2354 - protein, 20 aa, Artificial
  Short Peptide
RWKLLKKIPPPKFLHAAKKF

SEQ ID NO: 2355 - protein, 20 aa, Artificial
  Short Peptide
FWKLLKKIPPPKFLHAAKKF

SEQ ID NO: 2356 - protein, 20 aa, Artificial
  Short Peptide
KKKKLKKIPPPKFLHAAKKF

SEQ ID NO: 2357 - protein, 20 aa, Artificial
  Short Peptide
RKKKLKKIPPPKFLHAAKKF

SEQ ID NO: 2358 - protein, 20 aa, Artificial
  Short Peptide
FKKKLKKIPPPKFLHAAKKF

SEQ ID NO: 2359 - protein, 20 aa, Artificial
  Short Peptide
KWKKLKKIPPPKFLHAAKKF

SEQ ID NO: 2360 - protein, 20 aa, Artificial
  Short Peptide
RWKKLKKIPPPKFLHAAKKF

SEQ ID NO: 2361 - protein, 20 aa, Artificial
  Short Peptide
FWKKLKKIPPPKFLHAAKKF

SEQ ID NO: 2362 - protein, 19 aa, Artificial
  Short Peptide
KKKLFLKIPPKFLHAAKKF

SEQ ID NO: 2363 - protein, 19 aa, Artificial
  Short Peptide
RKKLFLKIPPKFLHAAKKF

SEQ ID NO: 2364 - protein, 19 aa, Artificial
  Short Peptide
FKKLFLKIPPKFLHAAKKF

SEQ ID NO: 2365 - protein, 19 aa, Artificial
  Short Peptide
KWKLFLKIPPKFLHAAKKF

SEQ ID NO: 2366 - protein, 19 aa, Artificial
  Short Peptide
RWKLFLKIPPKFLHAAKKF

SEQ ID NO: 2367 - protein, 19 aa, Artificial
  Short Peptide
FWKLFLKIPPKFLHAAKKF

SEQ ID NO: 2368 - protein, 19 aa, Artificial
  Short Peptide
KKKKFLKIPPKFLHAAKKF

SEQ ID NO: 2369 - protein, 19 aa, Artificial
  Short Peptide
RKKKFLKIPPKFLHAAKKF

SEQ ID NO: 2370 - protein, 19 aa, Artificial
  Short Peptide
FKKKFLKIPPKFLHAAKKF

SEQ ID NO: 2371 - protein, 19 aa, Artificial
  Short Peptide
KWKKFLKIPPKFLHAAKKF

SEQ ID NO: 2372 - protein, 19 aa, Artificial
  Short Peptide
RWKKFLKIPPKFLHAAKKF

SEQ ID NO: 2373 - protein, 19 aa, Artificial
  Short Peptide
FWKKFLKIPPKFLHAAKKF

SEQ ID NO: 2374 - protein, 19 aa, Artificial
  Short Peptide
KKKLLLKIPPKFLHAAKKF

SEQ ID NO: 2375 - protein, 19 aa, Artificial
  Short Peptide
RKKLLLKIPPKFLHAAKKF

SEQ ID NO: 2376 - protein, 19 aa, Artificial
  Short Peptide
FKKLLLKIPPKFLHAAKKF

SEQ ID NO: 2377 - protein, 19 aa, Artificial
  Short Peptide
KWKLLLKIPPKFLHAAKKF

SEQ ID NO: 2378 - protein, 19 aa, Artificial
  Short Peptide
RWKLLLKIPPKFLHAAKKF

SEQ ID NO: 2379 - protein, 19 aa, Artificial
  Short Peptide
FWKLLLKIPPKFLHAAKKF

SEQ ID NO: 2380 - protein, 19 aa, Artificial
  Short Peptide
KKKKLLKIPPKFLHAAKKF

SEQ ID NO: 2381 - protein, 19 aa, Artificial
  Short Peptide
RKKKLLKIPPKFLHAAKKF

SEQ ID NO: 2382 - protein, 19 aa, Artificial
  Short Peptide
FKKKLLKIPPKFLHAAKKF

SEQ ID NO: 2383 - protein, 19 aa, Artificial
  Short Peptide
KWKKLLKIPPKFLHAAKKF

SEQ ID NO: 2384 - protein, 19 aa, Artificial
  Short Peptide
RWKKLLKIPPKFLHAAKKF

SEQ ID NO: 2385 - protein, 19 aa, Artificial
  Short Peptide
FWKKLLKIPPKFLHAAKKF

SEQ ID NO: 2386 - protein, 19 aa, Artificial
  Short Peptide
KKKLFKKIPPKFLHAAKKF

SEQ ID NO: 2387 - protein, 19 aa, Artificial
  Short Peptide
RKKLFKKIPPKFLHAAKKF

SEQ ID NO: 2388 - protein, 19 aa, Artificial
  Short Peptide
FKKLFKKIPPKFLHAAKKF

SEQ ID NO: 2389 - protein, 19 aa, Artificial
  Short Peptide
KWKLFKKIPPKFLHAAKKF

SEQ ID NO: 2390 - protein, 19 aa, Artificial
  Short Peptide
RWKLFKKIPPKFLHAAKKF

SEQ ID NO: 2391 - protein, 19 aa, Artificial
  Short Peptide
FWKLFKKIPPKFLHAAKKF

SEQ ID NO: 2392 - protein, 19 aa, Artificial
  Short Peptide
KKKKFKKIPPKFLHAAKKF

SEQ ID NO: 2393 - protein, 19 aa, Artificial
  Short Peptide
RKKKFKKIPPKFLHAAKKF

SEQ ID NO: 2394 - protein, 19 aa, Artificial
  Short Peptide
FKKKFKKIPPKFLHAAKKF

SEQ ID NO: 2395 - protein, 19 aa, Artificial
  Short Peptide
KWKKFKKIPPKFLHAAKKF

SEQ ID NO: 2396 - protein, 19 aa, Artificial
  Short Peptide
RWKKFKKIPPKFLHAAKKF

SEQ ID NO: 2397 - protein, 19 aa, Artificial
  Short Peptide
FWKKFKKIPPKFLHAAKKF

SEQ ID NO: 2398 - protein, 19 aa, Artificial
  Short Peptide
KKKLLKKIPPKFLHAAKKF

SEQ ID NO: 2399 - protein, 19 aa, Artificial
  Short Peptide
RKKLLKKIPPKFLHAAKKF

SEQ ID NO: 2400 - protein, 19 aa, Artificial
  Short Peptide
FKKLLKKIPPKFLHAAKKF

SEQ ID NO: 2401 - protein, 19 aa, Artificial
  Short Peptide
KWKLLKKIPPKFLHAAKKF

SEQ ID NO: 2402 - protein, 19 aa, Artificial
  Short Peptide
RWKLLKKIPPKFLHAAKKF

SEQ ID NO: 2403 - protein, 19 aa, Artificial
  Short Peptide
FWKLLKKIPPKFLHAAKKF

SEQ ID NO: 2404 - protein, 19 aa, Artificial
  Short Peptide
KKKKLKKIPPKFLHAAKKF

SEQ ID NO: 2405 - protein, 19 aa, Artificial
  Short Peptide
RKKKLKKIPPKFLHAAKKF

SEQ ID NO: 2406 - protein, 19 aa, Artificial
  Short Peptide
FKKKLKKIPPKFLHAAKKF

SEQ ID NO: 2407 - protein, 19 aa, Artificial
  Short Peptide
KWKKLKKIPPKFLHAAKKF

SEQ ID NO: 2408 - protein, 19 aa, Artificial
  Short Peptide
RWKKLKKIPPKFLHAAKKF

SEQ ID NO: 2409 - protein, 19 aa, Artificial
  Short Peptide
FWKKLKKIPPKFLHAAKKF

SEQ ID NO: 2410 - protein, 18 aa, Artificial
  Short Peptide
KKKLFLKIPKFLHAAKKF

SEQ ID NO: 2411 - protein, 18 aa, Artificial
  Short Peptide
RKKLFLKIPKFLHAAKKF

SEQ ID NO: 2412 - protein, 18 aa, Artificial
  Short Peptide
FKKLFLKIPKFLHAAKKF

SEQ ID NO: 2413 - protein, 18 aa, Artificial
  Short Peptide
KWKLFLKIPKFLHAAKKF

SEQ ID NO: 2414 - protein, 18 aa, Artificial
  Short Peptide
RWKLFLKIPKFLHAAKKF

SEQ ID NO: 2415 - protein, 18 aa, Artificial
  Short Peptide
FWKLFLKIPKFLHAAKKF

SEQ ID NO: 2416 - protein, 18 aa, Artificial
  Short Peptide
KKKKFLKIPKFLHAAKKF

SEQ ID NO: 2417 - protein, 18 aa, Artificial
  Short Peptide
RKKKFLKIPKFLHAAKKF

SEQ ID NO: 2418 - protein, 18 aa, Artificial
  Short Peptide
FKKKFLKIPKFLHAAKKF

SEQ ID NO: 2419 - protein, 18 aa, Artificial
  Short Peptide
RWKKFLKIPKFLHAAKKF

SEQ ID NO: 2420 - protein, 18 aa, Artificial
  Short Peptide
FWKKFLKIPKFLHAAKKF

SEQ ID NO: 2421 - protein, 18 aa, Artificial
  Short Peptide
KKKLLLKIPKFLHAAKKF

SEQ ID NO: 2422 - protein, 18 aa, Artificial
  Short Peptide
RKKLLLKIPKFLHAAKKF

SEQ ID NO: 2423 - protein, 18 aa, Artificial
  Short Peptide
FKKLLLKIPKFLHAAKKF

SEQ ID NO: 2424 - protein, 18 aa, Artificial
  Short Peptide
KWKLLLKIPKFLHAAKKF

SEQ ID NO: 2425 - protein, 18 aa, Artificial
  Short Peptide
RWKLLLKIPKFLHAAKKF

SEQ ID NO: 2426 - protein, 18 aa, Artificial
  Short Peptide
FWKLLLKIPKFLHAAKKF

SEQ ID NO: 2427 - protein, 18 aa, Artificial
  Short Peptide
KKKKLLKIPKFLHAAKKF

SEQ ID NO: 2428 - protein, 18 aa, Artificial
  Short Peptide
RKKKLLKIPKFLHAAKKF

SEQ ID NO: 2429 - protein, 18 aa, Artificial
  Short Peptide
FKKKLLKIPKFLHAAKKF

SEQ ID NO: 2430 - protein, 18 aa, Artificial
  Short Peptide
RWKKLLKIPKFLHAAKKF

SEQ ID NO: 2431 - protein, 18 aa, Artificial
  Short Peptide
FWKKLLKIPKFLHAAKKF

SEQ ID NO: 2432 - protein, 18 aa, Artificial
  Short Peptide
KKKLFKKIPKFLHAAKKF

SEQ ID NO: 2433 - protein, 18 aa, Artificial
  Short Peptide
RKKLFKKIPKFLHAAKKF

SEQ ID NO: 2434 - protein, 18 aa, Artificial
  Short Peptide
RWKLFKKIPKFLHAAKKF

SEQ ID NO: 2435 - protein, 18 aa, Artificial
  Short Peptide
FWKLFKKIPKFLHAAKKF

SEQ ID NO: 2436 - protein, 18 aa, Artificial
  Short Peptide
KKKKFKKIPKFLHAAKKF

SEQ ID NO: 2437 - protein, 18 aa, Artificial
  Short Peptide
RKKKFKKIPKFLHAAKKF

SEQ ID NO: 2438 - protein, 18 aa, Artificial
  Short Peptide
FKKKFKKIPKFLHAAKKF

SEQ ID NO: 2439 - protein, 18 aa, Artificial
  Short Peptide
KWKKFKKIPKFLHAAKKF

SEQ ID NO: 2440 - protein, 18 aa, Artificial
  Short Peptide
RWKKFKKIPKFLHAAKKF

SEQ ID NO: 2441 - protein, 18 aa, Artificial
  Short Peptide
FWKKFKKIPKFLHAAKKF

SEQ ID NO: 2442 - protein, 18 aa, Artificial
  Short Peptide
KKKLLKKIPKFLHAAKKF

SEQ ID NO: 2443 - protein, 18 aa, Artificial
  Short Peptide
RKKLLKKIPKFLHAAKKF

SEQ ID NO: 2444 - protein, 18 aa, Artificial
  Short Peptide
FKKLLKKIPKFLHAAKKF

SEQ ID NO: 2445 - protein, 18 aa, Artificial
  Short Peptide
KWKLLKKIPKFLHAAKKF

SEQ ID NO: 2446 - protein, 18 aa, Artificial
  Short Peptide
RWKLLKKIPKFLHAAKKF

SEQ ID NO: 2447 - protein, 18 aa, Artificial
  Short Peptide
FWKLLKKIPKFLHAAKKF

SEQ ID NO: 2448 - protein, 18 aa, Artificial
  Short Peptide
KKKKLKKIPKFLHAAKKF

SEQ ID NO: 2449 - protein, 18 aa, Artificial
  Short Peptide
RKKKLKKIPKFLHAAKKF

SEQ ID NO: 2450 - protein, 18 aa, Artificial
  Short Peptide
FKKKLKKIPKFLHAAKKF

SEQ ID NO: 2451 - protein, 18 aa, Artificial
  Short Peptide
KWKKLKKIPKFLHAAKKF

SEQ ID NO: 2452 - protein, 18 aa, Artificial
  Short Peptide
RWKKLKKIPKFLHAAKKF

SEQ ID NO: 2453 - protein, 18 aa, Artificial
  Short Peptide
FWKKLKKIPKFLHAAKKF

SEQ ID NO: 2454 - protein, 20 aa, Artificial
  Short Peptide
KKKLFLKIPPPKFKHAAKKF

SEQ ID NO: 2455 - protein, 20 aa, Artificial
  Short Peptide
RKKLFLKIPPPKFKHAAKKF

SEQ ID NO: 2456 - protein, 20 aa, Artificial
  Short Peptide
FKKLFLKIPPPKFKHAAKKF

SEQ ID NO: 2457 - protein, 20 aa, Artificial
  Short Peptide
KWKLFLKIPPPKFKHAAKKF

SEQ ID NO: 2458 - protein, 20 aa, Artificial
  Short Peptide
RWKLFLKIPPPKFKHAAKKF

SEQ ID NO: 2459 - protein, 20 aa, Artificial
  Short Peptide
FWKLFLKIPPPKFKHAAKKF

SEQ ID NO: 2460 - protein, 20 aa, Artificial
  Short Peptide
KKKKFLKIPPPKFKHAAKKF

SEQ ID NO: 2461 - protein, 20 aa, Artificial
  Short Peptide
RKKKFLKIPPPKFKHAAKKF

SEQ ID NO: 2462 - protein, 20 aa, Artificial
  Short Peptide
FKKKFLKIPPPKFKHAAKKF

SEQ ID NO: 2463 - protein, 20 aa, Artificial
  Short Peptide
KWKKFLKIPPPKFKHAAKKF

SEQ ID NO: 2464 - protein, 20 aa, Artificial
  Short Peptide
RWKKFLKIPPPKFKHAAKKF

SEQ ID NO: 2465 - protein, 20 aa, Artificial
  Short Peptide
FWKKFLKIPPPKFKHAAKKF

SEQ ID NO: 2466 - protein, 20 aa, Artificial
  Short Peptide
KKKLLLKIPPPKFKHAAKKF

SEQ ID NO: 2467 - protein, 20 aa, Artificial
  Short Peptide
RKKLLLKIPPPKFKHAAKKF

SEQ ID NO: 2468 - protein, 20 aa, Artificial
  Short Peptide
FKKLLLKIPPPKFKHAAKKF

SEQ ID NO: 2469 - protein, 20 aa, Artificial
  Short Peptide
KWKLLLKIPPPKFKHAAKKF

SEQ ID NO: 2470 - protein, 20 aa, Artificial
  Short Peptide
RWKLLLKIPPPKFKHAAKKF

SEQ ID NO: 2471 - protein, 20 aa, Artificial
  Short Peptide
FWKLLLKIPPPKFKHAAKKF

SEQ ID NO: 2472 - protein, 20 aa, Artificial
  Short Peptide
KKKKLLKIPPPKFKHAAKKF

SEQ ID NO: 2473 - protein, 20 aa, Artificial
  Short Peptide
RKKKLLKIPPPKFKHAAKKF

SEQ ID NO: 2474 - protein, 20 aa, Artificial
  Short Peptide
FKKKLLKIPPPKFKHAAKKF

SEQ ID NO: 2475 - protein, 20 aa, Artificial
  Short Peptide
KWKKLLKIPPPKFKHAAKKF

SEQ ID NO: 2476 - protein, 20 aa, Artificial
  Short Peptide
RWKKLLKIPPPKFKHAAKKF

SEQ ID NO: 2477 - protein, 20 aa, Artificial
  Short Peptide
FWKKLLKIPPPKFKHAAKKF

SEQ ID NO: 2478 - protein, 20 aa, Artificial
  Short Peptide
KKKLFKKIPPPKFKHAAKKF

SEQ ID NO: 2479 - protein, 20 aa, Artificial
  Short Peptide
RKKLFKKIPPPKFKHAAKKF

SEQ ID NO: 2480 - protein, 20 aa, Artificial
  Short Peptide
FKKLFKKIPPPKFKHAAKKF

SEQ ID NO: 2481 - protein, 20 aa, Artificial
  Short Peptide
KWKLFKKIPPPKFKHAAKKF

SEQ ID NO: 2482 - protein, 20 aa, Artificial
  Short Peptide
RWKLFKKIPPPKFKHAAKKF

SEQ ID NO: 2483 - protein, 20 aa, Artificial
  Short Peptide
FWKLFKKIPPPKFKHAAKKF

SEQ ID NO: 2484 - protein, 20 aa, Artificial
  Short Peptide
KKKKFKKIPPPKFKHAAKKF

SEQ ID NO: 2485 - protein, 20 aa, Artificial
  Short Peptide
RKKKFKKIPPPKFKHAAKKF

SEQ ID NO: 2486 - protein, 20 aa, Artificial
  Short Peptide
FKKKFKKIPPPKFKHAAKKF

SEQ ID NO: 2487 - protein, 20 aa, Artificial
  Short Peptide
KWKKFKKIPPPKFKHAAKKF

SEQ ID NO: 2488 - protein, 20 aa, Artificial
  Short Peptide
RWKKFKKIPPPKFKHAAKKF

SEQ ID NO: 2489 - protein, 20 aa, Artificial
  Short Peptide
FWKKFKKIPPPKFKHAAKKF

SEQ ID NO: 2490 - protein, 20 aa, Artificial
  Short Peptide
KKKLLKKIPPPKFKHAAKKF

SEQ ID NO: 2491 - protein, 20 aa, Artificial
  Short Peptide
RKKLLKKIPPPKFKHAAKKF

SEQ ID NO: 2492 - protein, 20 aa, Artificial
  Short Peptide
FKKLLKKIPPPKFKHAAKKF

SEQ ID NO: 2493 - protein, 20 aa, Artificial
  Short Peptide
KWKLLKKIPPPKFKHAAKKF

SEQ ID NO: 2494 - protein, 20 aa, Artificial
  Short Peptide
RWKLLKKIPPPKFKHAAKKF

SEQ ID NO: 2495 - protein, 20 aa, Artificial
  Short Peptide
FWKLLKKIPPPKFKHAAKKF

SEQ ID NO: 2496 - protein, 20 aa, Artificial
  Short Peptide
KKKKLKKIPPPKFKHAAKKF

SEQ ID NO: 2497 - protein, 20 aa, Artificial
  Short Peptide
RKKKLKKIPPPKFKHAAKKF

SEQ ID NO: 2498 - protein, 20 aa, Artificial
  Short Peptide
FKKKLKKIPPPKFKHAAKKF

SEQ ID NO: 2499 - protein, 20 aa, Artificial
  Short Peptide
KWKKLKKIPPPKFKHAAKKF

SEQ ID NO: 2500 - protein, 20 aa, Artificial
  Short Peptide
RWKKLKKIPPPKFKHAAKKF

SEQ ID NO: 2501 - protein, 20 aa, Artificial
  Short Peptide
FWKKLKKIPPPKFKHAAKKF

SEQ ID NO: 2502 - protein, 19 aa, Artificial
  Short Peptide
KKKLFLKIPPKFKHAAKKF

SEQ ID NO: 2503 - protein, 19 aa, Artificial
  Short Peptide
RKKLFLKIPPKFKHAAKKF

SEQ ID NO: 2504 - protein, 19 aa, Artificial
  Short Peptide
FKKLFLKIPPKFKHAAKKF

SEQ ID NO: 2505 - protein, 19 aa, Artificial
  Short Peptide
KWKLFLKIPPKFKHAAKKF

SEQ ID NO: 2506 - protein, 19 aa, Artificial
  Short Peptide
RWKLFLKIPPKFKHAAKKF

SEQ ID NO: 2507 - protein, 19 aa, Artificial
  Short Peptide
FWKLFLKIPPKFKHAAKKF

SEQ ID NO: 2508 - protein, 19 aa, Artificial
  Short Peptide
KKKKFLKIPPKFKHAAKKF

SEQ ID NO: 2509 - protein, 19 aa, Artificial
  Short Peptide
RKKKFLKIPPKFKHAAKKF

SEQ ID NO: 2510 - protein, 19 aa, Artificial
  Short Peptide
FKKKFLKIPPKFKHAAKKF

SEQ ID NO: 2511 - protein, 19 aa, Artificial
  Short Peptide
KWKKFLKIPPKFKHAAKKF

SEQ ID NO: 2512 - protein, 19 aa, Artificial
  Short Peptide
RWKKFLKIPPKFKHAAKKF

SEQ ID NO: 2513 - protein, 19 aa, Artificial
  Short Peptide
FWKKFLKIPPKFKHAAKKF

SEQ ID NO: 2514 - protein, 19 aa, Artificial
  Short Peptide
KKKLLLKIPPKFKHAAKKF

SEQ ID NO: 2515 - protein, 19 aa, Artificial
  Short Peptide
RKKLLLKIPPKFKHAAKKF

SEQ ID NO: 2516 - protein, 19 aa, Artificial
  Short Peptide
FKKLLLKIPPKFKHAAKKF

SEQ ID NO: 2517 - protein, 19 aa, Artificial
  Short Peptide
KWKLLLKIPPKFKHAAKKF

SEQ ID NO: 2518 - protein, 19 aa, Artificial
  Short Peptide
RWKLLLKIPPKFKHAAKKF

SEQ ID NO: 2519 - protein, 19 aa, Artificial
  Short Peptide
FWKLLLKIPPKFKHAAKKF

SEQ ID NO: 2520 - protein, 19 aa, Artificial
  Short Peptide
KKKKLLKIPPKFKHAAKKF

SEQ ID NO: 2521 - protein, 19 aa, Artificial
  Short Peptide
RKKKLLKIPPKFKHAAKKF

SEQ ID NO: 2522 - protein, 19 aa, Artificial
  Short Peptide
FKKKLLKIPPKFKHAAKKF

SEQ ID NO: 2523 - protein, 19 aa, Artificial
  Short Peptide
KWKKLLKIPPKFKHAAKKF

SEQ ID NO: 2524 - protein, 19 aa, Artificial
  Short Peptide
RWKKLLKIPPKFKHAAKKF

SEQ ID NO: 2525 - protein, 19 aa, Artificial
  Short Peptide
FWKKLLKIPPKFKHAAKKF

SEQ ID NO: 2526 - protein, 19 aa, Artificial
  Short Peptide
KKKLFKKIPPKFKHAAKKF

SEQ ID NO: 2527 - protein, 19 aa, Artificial
  Short Peptide
RKKLFKKIPPKFKHAAKKF

SEQ ID NO: 2528 - protein, 19 aa, Artificial
  Short Peptide
FKKLFKKIPPKFKHAAKKF

SEQ ID NO: 2529 - protein, 19 aa, Artificial
  Short Peptide
KWKLFKKIPPKFKHAAKKF

SEQ ID NO: 2530 - protein, 19 aa, Artificial
  Short Peptide
RWKLFKKIPPKFKHAAKKF

SEQ ID NO: 2531 - protein, 19 aa, Artificial
  Short Peptide
FWKLFKKIPPKFKHAAKKF

SEQ ID NO: 2532 - protein, 19 aa, Artificial
  Short Peptide
KKKKFKKIPPKFKHAAKKF

SEQ ID NO: 2533 - protein, 19 aa, Artificial
  Short Peptide
RKKKFKKIPPKFKHAAKKF

SEQ ID NO: 2534 - protein, 19 aa, Artificial
  Short Peptide
FKKKFKKIPPKFKHAAKKF

SEQ ID NO: 2535 - protein, 19 aa, Artificial
  Short Peptide
KWKKFKKIPPKFKHAAKKF

SEQ ID NO: 2536 - protein, 19 aa, Artificial
  Short Peptide
RWKKFKKIPPKFKHAAKKF

SEQ ID NO: 2537 - protein, 19 aa, Artificial
  Short Peptide
FWKKFKKIPPKFKHAAKKF

SEQ ID NO: 2538 - protein, 19 aa, Artificial
  Short Peptide
KKKLLKKIPPKFKHAAKKF

SEQ ID NO: 2539 - protein, 19 aa, Artificial
  Short Peptide
RKKLLKKIPPKFKHAAKKF

SEQ ID NO: 2540 - protein, 19 aa, Artificial
  Short Peptide
FKKLLKKIPPKFKHAAKKF

SEQ ID NO: 2541 - protein, 19 aa, Artificial
  Short Peptide
KWKLLKKIPPKFKHAAKKF

SEQ ID NO: 2542 - protein, 19 aa, Artificial
  Short Peptide
RWKLLKKIPPKFKHAAKKF

SEQ ID NO: 2543 - protein, 19 aa, Artificial
  Short Peptide
FWKLLKKIPPKFKHAAKKF

SEQ ID NO: 2544 - protein, 19 aa, Artificial
  Short Peptide
KKKKLKKIPPKFKHAAKKF

SEQ ID NO: 2545 - protein, 19 aa, Artificial
  Short Peptide
RKKKLKKIPPKFKHAAKKF

SEQ ID NO: 2546 - protein, 19 aa, Artificial
  Short Peptide
FKKKLKKIPPKFKHAAKKF

SEQ ID NO: 2547 - protein, 19 aa, Artificial
  Short Peptide
KWKKLKKIPPKFKHAAKKF

SEQ ID NO: 2548 - protein, 19 aa, Artificial
  Short Peptide
RWKKLKKIPPKFKHAAKKF

SEQ ID NO: 2549 - protein, 19 aa, Artificial
  Short Peptide
FWKKLKKIPPKFKHAAKKF

SEQ ID NO: 2550 - protein, 18 aa, Artificial
  Short Peptide
KKKLFLKIPKFKHAAKKF

SEQ ID NO: 2551 - protein, 18 aa, Artificial
  Short Peptide
RKKLFLKIPKFKHAAKKF

SEQ ID NO: 2552 - protein, 18 aa, Artificial
  Short Peptide
FKKLFLKIPKFKHAAKKF

SEQ ID NO: 2553 - protein, 18 aa, Artificial
  Short Peptide
KWKLFLKIPKFKHAAKKF

SEQ ID NO: 2554 - protein, 18 aa, Artificial
  Short Peptide
RWKLFLKIPKFKHAAKKF

SEQ ID NO: 2555 - protein, 18 aa, Artificial
  Short Peptide
FWKLFLKIPKFKHAAKKF

SEQ ID NO: 2556 - protein, 18 aa, Artificial
  Short Peptide
KKKKFLKIPKFKHAAKKF

SEQ ID NO: 2557 - protein, 18 aa, Artificial
  Short Peptide
RKKKFLKIPKFKHAAKKF

SEQ ID NO: 2558 - protein, 18 aa, Artificial
  Short Peptide
FKKKFLKIPKFKHAAKKF

SEQ ID NO: 2559 - protein, 18 aa, Artificial
  Short Peptide
KWKKFLKIPKFKHAAKKF

SEQ ID NO: 2560 - protein, 18 aa, Artificial
  Short Peptide
RWKKFLKIPKFKHAAKKF

SEQ ID NO: 2561 - protein, 18 aa, Artificial
  Short Peptide
FWKKFLKIPKFKHAAKKF

SEQ ID NO: 2562 - protein, 18 aa, Artificial
  Short Peptide
KKKLLLKIPKFKHAAKKF

SEQ ID NO: 2563 - protein, 18 aa, Artificial
  Short Peptide
RKKLLLKIPKFKHAAKKF

SEQ ID NO: 2564 - protein, 18 aa, Artificial
  Short Peptide
FKKLLLKIPKFKHAAKKF

SEQ ID NO: 2565 - protein, 18 aa, Artificial
  Short Peptide
KWKLLLKIPKFKHAAKKF

SEQ ID NO: 2566 - protein, 18 aa, Artificial
  Short Peptide
RWKLLLKIPKFKHAAKKF

SEQ ID NO: 2567 - protein, 18 aa, Artificial
  Short Peptide
FWKLLLKIPKFKHAAKKF

SEQ ID NO: 2568 - protein, 18 aa, Artificial
  Short Peptide
KKKKLLKIPKFKHAAKKF

SEQ ID NO: 2569 - protein, 18 aa, Artificial
  Short Peptide
RKKKLLKIPKFKHAAKKF

SEQ ID NO: 2570 - protein, 18 aa, Artificial
  Short Peptide
FKKKLLKIPKFKHAAKKF

SEQ ID NO: 2571 - protein, 18 aa, Artificial
  Short Peptide
KWKKLLKIPKFKHAAKKF

SEQ ID NO: 2572 - protein, 18 aa, Artificial
  Short Peptide
RWKKLLKIPKFKHAAKKF

SEQ ID NO: 2573 - protein, 18 aa, Artificial
  Short Peptide
FWKKLLKIPKFKHAAKKF

SEQ ID NO: 2574 - protein, 18 aa, Artificial
  Short Peptide
KKKLFKKIPKFKHAAKKF

SEQ ID NO: 2575 - protein, 18 aa, Artificial
  Short Peptide
RKKLFKKIPKFKHAAKKF

SEQ ID NO: 2576 - protein, 18 aa, Artificial
  Short Peptide
FKKLFKKIPKFKHAAKKF

SEQ ID NO: 2577 - protein, 18 aa, Artificial
  Short Peptide
KWKLFKKIPKFKHAAKKF

SEQ ID NO: 2578 - protein, 18 aa, Artificial
  Short Peptide
RWKLFKKIPKFKHAAKKF

SEQ ID NO: 2579 - protein, 18 aa, Artificial
  Short Peptide
FWKLFKKIPKFKHAAKKF

SEQ ID NO: 2580 - protein, 18 aa, Artificial
  Short Peptide
KKKKFKKIPKFKHAAKKF

SEQ ID NO: 2581 - protein, 18 aa, Artificial
  Short Peptide
RKKKFKKIPKFKHAAKKF

SEQ ID NO: 2582 - protein, 18 aa, Artificial
  Short Peptide
FKKKFKKIPKFKHAAKKF

SEQ ID NO: 2583 - protein, 18 aa, Artificial
  Short Peptide
KWKKFKKIPKFKHAAKKF

SEQ ID NO: 2584 - protein, 18 aa, Artificial
  Short Peptide
RWKKFKKIPKFKHAAKKF

SEQ ID NO: 2585 - protein, 18 aa, Artificial
  Short Peptide
FWKKFKKIPKFKHAAKKF

SEQ ID NO: 2586 - protein, 18 aa, Artificial
  Short Peptide
KKKLLKKIPKFKHAAKKF

SEQ ID NO: 2587 - protein, 18 aa, Artificial
  Short Peptide
RKKLLKKIPKFKHAAKKF

SEQ ID NO: 2588 - protein, 18 aa, Artificial
  Short Peptide
FKKLLKKIPKFKHAAKKF

SEQ ID NO: 2589 - protein, 18 aa, Artificial
  Short Peptide
KWKLLKKIPKFKHAAKKF

SEQ ID NO: 2590 - protein, 18 aa, Artificial
  Short Peptide
RWKLLKKIPKFKHAAKKF

SEQ ID NO: 2591 - protein, 18 aa, Artificial
  Short Peptide
FWKLLKKIPKFKHAAKKF

SEQ ID NO: 2592 - protein, 18 aa, Artificial
  Short Peptide
KKKKLKKIPKFKHAAKKF

SEQ ID NO: 2593 - protein, 18 aa, Artificial
  Short Peptide
RKKKLKKIPKFKHAAKKF

SEQ ID NO: 2594 - protein, 18 aa, Artificial
  Short Peptide
FKKKLKKIPKFKHAAKKF

SEQ ID NO: 2595 - protein, 18 aa, Artificial
  Short Peptide
KWKKLKKIPKFKHAAKKF

SEQ ID NO: 2596 - protein, 18 aa, Artificial
  Short Peptide
RWKKLKKIPKFKHAAKKF

SEQ ID NO: 2597 - protein, 18 aa, Artificial
  Short Peptide
FWKKLKKIPKFKHAAKKF

SEQ ID NO: 2598 - protein, 20 aa, Artificial
  Short Peptide
KKKLFLKIPPPKFLKAAKKF

SEQ ID NO: 2599 - protein, 20 aa, Artificial
  Short Peptide
RKKLFLKIPPPKFLKAAKKF

SEQ ID NO: 2600 - protein, 20 aa, Artificial
  Short Peptide
FKKLFLKIPPPKFLKAAKKF

SEQ ID NO: 2601 - protein, 20 aa, Artificial
  Short Peptide
KWKLFLKIPPPKFLKAAKKF

SEQ ID NO: 2602 - protein, 20 aa, Artificial
  Short Peptide
RWKLFLKIPPPKFLKAAKKF

SEQ ID NO: 2603 - protein, 20 aa, Artificial
  Short Peptide
FWKLFLKIPPPKFLKAAKKF

SEQ ID NO: 2604 - protein, 20 aa, Artificial
  Short Peptide
KKKKFLKIPPPKFLKAAKKF

SEQ ID NO: 2605 - protein, 20 aa, Artificial
  Short Peptide
RKKKFLKIPPPKFLKAAKKF

SEQ ID NO: 2606 - protein, 20 aa, Artificial
  Short Peptide
FKKKFLKIPPPKFLKAAKKF

SEQ ID NO: 2607 - protein, 20 aa, Artificial
  Short Peptide
KWKKFLKIPPPKFLKAAKKF

SEQ ID NO: 2608 - protein, 20 aa, Artificial
  Short Peptide
RWKKFLKIPPPKFLKAAKKF

SEQ ID NO: 2609 - protein, 20 aa, Artificial
  Short Peptide
FWKKFLKIPPPKFLKAAKKF

SEQ ID NO: 2610 - protein, 20 aa, Artificial
  Short Peptide
KKKLLLKIPPPKFLKAAKKF

SEQ ID NO: 2611 - protein, 20 aa, Artificial
  Short Peptide
RKKLLLKIPPPKFLKAAKKF

SEQ ID NO: 2612 - protein, 20 aa, Artificial
  Short Peptide
FKKLLLKIPPPKFLKAAKKF

SEQ ID NO: 2613 - protein, 20 aa, Artificial
  Short Peptide
KWKLLLKIPPPKFLKAAKKF

SEQ ID NO: 2614 - protein, 20 aa, Artificial
  Short Peptide
RWKLLLKIPPPKFLKAAKKF

SEQ ID NO: 2615 - protein, 20 aa, Artificial
  Short Peptide
FWKLLLKIPPPKFLKAAKKF

SEQ ID NO: 2616 - protein, 20 aa, Artificial
  Short Peptide
KKKKLLKIPPPKFLKAAKKF

SEQ ID NO: 2617 - protein, 20 aa, Artificial
  Short Peptide
RKKKLLKIPPPKFLKAAKKF

SEQ ID NO: 2618 - protein, 20 aa, Artificial
  Short Peptide
FKKKLLKIPPPKFLKAAKKF

SEQ ID NO: 2619 - protein, 20 aa, Artificial
  Short Peptide
KWKKLLKIPPPKFLKAAKKF

SEQ ID NO: 2620 - protein, 20 aa, Artificial
  Short Peptide
RWKKLLKIPPPKFLKAAKKF

SEQ ID NO: 2621 - protein, 20 aa, Artificial
  Short Peptide
FWKKLLKIPPPKFLKAAKKF

SEQ ID NO: 2622 - protein, 20 aa, Artificial
  Short Peptide
KKKLFKKIPPPKFLKAAKKF

SEQ ID NO: 2623 - protein, 20 aa, Artificial
  Short Peptide
RKKLFKKIPPPKFLKAAKKF

SEQ ID NO: 2624 - protein, 20 aa, Artificial
  Short Peptide
FKKLFKKIPPPKFLKAAKKF

SEQ ID NO: 2625 - protein, 20 aa, Artificial
  Short Peptide
KWKLFKKIPPPKFLKAAKKF

SEQ ID NO: 2626 - protein, 20 aa, Artificial
  Short Peptide
RWKLFKKIPPPKFLKAAKKF

SEQ ID NO: 2627 - protein, 20 aa, Artificial
  Short Peptide
FWKLFKKIPPPKFLKAAKKF

SEQ ID NO: 2628 - protein, 20 aa, Artificial
  Short Peptide
KKKKFKKIPPPKFLKAAKKF

SEQ ID NO: 2629 - protein, 20 aa, Artificial
  Short Peptide
RKKKFKKIPPPKFLKAAKKF

SEQ ID NO: 2630 - protein, 20 aa, Artificial
  Short Peptide
FKKKFKKIPPPKFLKAAKKF

SEQ ID NO: 2631 - protein, 20 aa, Artificial
  Short Peptide
KWKKFKKIPPPKFLKAAKKF

SEQ ID NO: 2632 - protein, 20 aa, Artificial
  Short Peptide
RWKKFKKIPPPKFLKAAKKF

SEQ ID NO: 2633 - protein, 20 aa, Artificial
  Short Peptide
FWKKFKKIPPPKFLKAAKKF

SEQ ID NO: 2634 - protein, 20 aa, Artificial
  Short Peptide
KKKLLKKIPPPKFLKAAKKF

SEQ ID NO: 2635 - protein, 20 aa, Artificial
  Short Peptide
RKKLLKKIPPPKFLKAAKKF

SEQ ID NO: 2636 - protein, 20 aa, Artificial
  Short Peptide
FKKLLKKIPPPKFLKAAKKF

SEQ ID NO: 2637 - protein, 20 aa, Artificial
  Short Peptide
KWKLLKKIPPPKFLKAAKKF

SEQ ID NO: 2638 - protein, 20 aa, Artificial
  Short Peptide
RWKLLKKIPPPKFLKAAKKF

SEQ ID NO: 2639 - protein, 20 aa, Artificial
  Short Peptide
FWKLLKKIPPPKFLKAAKKF

SEQ ID NO: 2640 - protein, 20 aa, Artificial
  Short Peptide
KKKKLKKIPPPKFLKAAKKF

SEQ ID NO: 2641 - protein, 20 aa, Artificial
  Short Peptide
RKKKLKKIPPPKFLKAAKKF

SEQ ID NO: 2642 - protein, 20 aa, Artificial
  Short Peptide
FKKKLKKIPPPKFLKAAKKF

SEQ ID NO: 2643 - protein, 20 aa, Artificial
  Short Peptide
KWKKLKKIPPPKFLKAAKKF

SEQ ID NO: 2644 - protein, 20 aa, Artificial
  Short Peptide
RWKKLKKIPPPKFLKAAKKF

SEQ ID NO: 2645 - protein, 20 aa, Artificial
  Short Peptide
FWKKLKKIPPPKFLKAAKKF

SEQ ID NO: 2646 - protein, 19 aa, Artificial
  Short Peptide
KKKLFLKIPPKFLKAAKKF

SEQ ID NO: 2647 - protein, 19 aa, Artificial
  Short Peptide
RKKLFLKIPPKFLKAAKKF

SEQ ID NO: 2648 - protein, 19 aa, Artificial
  Short Peptide
FKKLFLKIPPKFLKAAKKF

SEQ ID NO: 2649 - protein, 19 aa, Artificial
  Short Peptide
KWKLFLKIPPKFLKAAKKF

SEQ ID NO: 2650 - protein, 19 aa, Artificial
  Short Peptide
RWKLFLKIPPKFLKAAKKF

SEQ ID NO: 2651 - protein, 19 aa, Artificial
  Short Peptide
FWKLFLKIPPKFLKAAKKF

SEQ ID NO: 2652 - protein, 19 aa, Artificial
  Short Peptide
KKKKFLKIPPKFLKAAKKF

SEQ ID NO: 2653 - protein, 19 aa, Artificial
  Short Peptide
RKKKFLKIPPKFLKAAKKF

SEQ ID NO: 2654 - protein, 19 aa, Artificial
  Short Peptide
FKKKFLKIPPKFLKAAKKF

SEQ ID NO: 2655 - protein, 19 aa, Artificial
  Short Peptide
KWKKFLKIPPKFLKAAKKF

SEQ ID NO: 2656 - protein, 19 aa, Artificial
  Short Peptide
RWKKFLKIPPKFLKAAKKF

SEQ ID NO: 2657 - protein, 19 aa, Artificial
  Short Peptide
FWKKFLKIPPKFLKAAKKF

SEQ ID NO: 2658 - protein, 19 aa, Artificial
  Short Peptide
KKKLLLKIPPKFLKAAKKF

SEQ ID NO: 2659 - protein, 19 aa, Artificial
  Short Peptide
RKKLLLKIPPKFLKAAKKF

SEQ ID NO: 2660 - protein, 19 aa, Artificial
  Short Peptide
FKKLLLKIPPKFLKAAKKF

SEQ ID NO: 2661 - protein, 19 aa, Artificial
  Short Peptide
KWKLLLKIPPKFLKAAKKF

SEQ ID NO: 2662 - protein, 19 aa, Artificial
  Short Peptide
RWKLLLKIPPKFLKAAKKF

SEQ ID NO: 2663 - protein, 19 aa, Artificial
  Short Peptide
FWKLLLKIPPKFLKAAKKF

SEQ ID NO: 2664 - protein, 19 aa, Artificial
  Short Peptide
KKKKLLKIPPKFLKAAKKF

SEQ ID NO: 2665 - protein, 19 aa, Artificial
  Short Peptide
RKKKLLKIPPKFLKAAKKF

SEQ ID NO: 2666 - protein, 19 aa, Artificial
  Short Peptide
FKKKLLKIPPKFLKAAKKF

SEQ ID NO: 2667 - protein, 19 aa, Artificial
  Short Peptide
KWKKLLKIPPKFLKAAKKF

SEQ ID NO: 2668 - protein, 19 aa, Artificial
  Short Peptide
RWKKLLKIPPKFLKAAKKF

SEQ ID NO: 2669 - protein, 19 aa, Artificial
  Short Peptide
FWKKLLKIPPKFLKAAKKF

SEQ ID NO: 2670 - protein, 19 aa, Artificial
  Short Peptide
KKKLFKKIPPKFLKAAKKF

SEQ ID NO: 2671 - protein, 19 aa, Artificial
  Short Peptide
RKKLFKKIPPKFLKAAKKF

SEQ ID NO: 2672 - protein, 19 aa, Artificial
  Short Peptide
FKKLFKKIPPKFLKAAKKF

SEQ ID NO: 2673 - protein, 19 aa, Artificial
  Short Peptide
KWKLFKKIPPKFLKAAKKF

SEQ ID NO: 2674 - protein, 19 aa, Artificial
  Short Peptide
RWKLFKKIPPKFLKAAKKF

SEQ ID NO: 2675 - protein, 19 aa, Artificial
  Short Peptide
FWKLFKKIPPKFLKAAKKF

SEQ ID NO: 2676 - protein, 19 aa, Artificial
  Short Peptide
KKKKFKKIPPKFLKAAKKF

SEQ ID NO: 2677 - protein, 19 aa, Artificial
  Short Peptide
RKKKFKKIPPKFLKAAKKF

SEQ ID NO: 2678 - protein, 19 aa, Artificial
  Short Peptide
FKKKFKKIPPKFLKAAKKF

SEQ ID NO: 2679 - protein, 19 aa, Artificial
  Short Peptide
KWKKFKKIPPKFLKAAKKF

SEQ ID NO: 2680 - protein, 19 aa, Artificial
  Short Peptide
RWKKFKKIPPKFLKAAKKF

SEQ ID NO: 2681 - protein, 19 aa, Artificial
  Short Peptide
FWKKFKKIPPKFLKAAKKF

SEQ ID NO: 2682 - protein, 19 aa, Artificial
  Short Peptide
KKKLLKKIPPKFLKAAKKF

SEQ ID NO: 2683 - protein, 19 aa, Artificial
  Short Peptide
RKKLLKKIPPKFLKAAKKF

SEQ ID NO: 2684 - protein, 19 aa, Artificial
  Short Peptide
FKKLLKKIPPKFLKAAKKF

SEQ ID NO: 2685 - protein, 19 aa, Artificial
  Short Peptide
KWKLLKKIPPKFLKAAKKF

SEQ ID NO: 2686 - protein, 19 aa, Artificial
  Short Peptide
RWKLLKKIPPKFLKAAKKF

SEQ ID NO: 2687 - protein, 19 aa, Artificial
  Short Peptide
FWKLLKKIPPKFLKAAKKF

SEQ ID NO: 2688 - protein, 19 aa, Artificial
  Short Peptide
KKKKLKKIPPKFLKAAKKF

SEQ ID NO: 2689 - protein, 19 aa, Artificial
  Short Peptide
RKKKLKKIPPKFLKAAKKF

SEQ ID NO: 2690 - protein, 19 aa, Artificial
  Short Peptide
FKKKLKKIPPKFLKAAKKF

SEQ ID NO: 2691 - protein, 19 aa, Artificial
  Short Peptide
KWKKLKKIPPKFLKAAKKF

SEQ ID NO: 2692 - protein, 19 aa, Artificial
  Short Peptide
RWKKLKKIPPKFLKAAKKF

SEQ ID NO: 2693 - protein, 19 aa, Artificial
  Short Peptide
FWKKLKKIPPKFLKAAKKF

SEQ ID NO: 2694 - protein, 18 aa, Artificial
  Short Peptide
KKKLFLKIPKFLKAAKKF

SEQ ID NO: 2695 - protein, 18 aa, Artificial
  Short Peptide
RKKLFLKIPKFLKAAKKF

SEQ ID NO: 2696 - protein, 18 aa, Artificial
  Short Peptide
FKKLFLKIPKFLKAAKKF

SEQ ID NO: 2697 - protein, 18 aa, Artificial
  Short Peptide
KWKLFLKIPKFLKAAKKF

SEQ ID NO: 2698 - protein, 18 aa, Artificial
  Short Peptide
RWKLFLKIPKFLKAAKKF

SEQ ID NO: 2699 - protein, 18 aa, Artificial
  Short Peptide
FWKLFLKIPKFLKAAKKF

SEQ ID NO: 2700 - protein, 18 aa, Artificial
  Short Peptide
KKKKFLKIPKFLKAAKKF

SEQ ID NO: 2701 - protein, 18 aa, Artificial
  Short Peptide
RKKKFLKIPKFLKAAKKF

SEQ ID NO: 2702 - protein, 18 aa, Artificial
  Short Peptide
FKKKFLKIPKFLKAAKKF

SEQ ID NO: 2703 - protein, 18 aa, Artificial
  Short Peptide
KWKKFLKIPKFLKAAKKF

SEQ ID NO: 2704 - protein, 18 aa, Artificial
  Short Peptide
RWKKFLKIPKFLKAAKKF

SEQ ID NO: 2705 - protein, 18 aa, Artificial
  Short Peptide
FWKKFLKIPKFLKAAKKF

SEQ ID NO: 2706 - protein, 18 aa, Artificial
  Short Peptide
KKKLLLKIPKFLKAAKKF

SEQ ID NO: 2707 - protein, 18 aa, Artificial
  Short Peptide
RKKLLLKIPKFLKAAKKF

SEQ ID NO: 2708 - protein, 18 aa, Artificial
  Short Peptide
FKKLLLKIPKFLKAAKKF

SEQ ID NO: 2709 - protein, 18 aa, Artificial
  Short Peptide
KWKLLLKIPKFLKAAKKF

SEQ ID NO: 2710 - protein, 18 aa, Artificial
  Short Peptide
RWKLLLKIPKFLKAAKKF

SEQ ID NO: 2711 - protein, 18 aa, Artificial
  Short Peptide
FWKLLLKIPKFLKAAKKF

SEQ ID NO: 2712 - protein, 18 aa, Artificial
  Short Peptide
KKKKLLKIPKFLKAAKKF

SEQ ID NO: 2713 - protein, 18 aa, Artificial
  Short Peptide
RKKKLLKIPKFLKAAKKF

SEQ ID NO: 2714 - protein, 18 aa, Artificial
  Short Peptide
FKKKLLKIPKFLKAAKKF

SEQ ID NO: 2715 - protein, 18 aa, Artificial
  Short Peptide
KWKKLLKIPKFLKAAKKF

SEQ ID NO: 2716 - protein, 18 aa, Artificial
  Short Peptide
RWKKLLKIPKFLKAAKKF

SEQ ID NO: 2717 - protein, 18 aa, Artificial
  Short Peptide
FWKKLLKIPKFLKAAKKF

SEQ ID NO: 2718 - protein, 18 aa, Artificial
  Short Peptide
KKKLFKKIPKFLKAAKKF

SEQ ID NO: 2719 - protein, 18 aa, Artificial
  Short Peptide
RKKLFKKIPKFLKAAKKF

SEQ ID NO: 2720 - protein, 18 aa, Artificial
  Short Peptide
FKKLFKKIPKFLKAAKKF

SEQ ID NO: 2721 - protein, 18 aa, Artificial
  Short Peptide
KWKLFKKIPKFLKAAKKF

SEQ ID NO: 2722 - protein, 18 aa, Artificial
  Short Peptide
RWKLFKKIPKFLKAAKKF

SEQ ID NO: 2723 - protein, 18 aa, Artificial
  Short Peptide
FWKLFKKIPKFLKAAKKF

SEQ ID NO: 2724 - protein, 18 aa, Artificial
  Short Peptide
KKKKFKKIPKFLKAAKKF

SEQ ID NO: 2725 - protein, 18 aa, Artificial
  Short Peptide
RKKKFKKIPKFLKAAKKF

SEQ ID NO: 2726 - protein, 18 aa, Artificial
  Short Peptide
FKKKFKKIPKFLKAAKKF

SEQ ID NO: 2727 - protein, 18 aa, Artificial
  Short Peptide
KWKKFKKIPKFLKAAKKF

SEQ ID NO: 2728 - protein, 18 aa, Artificial
  Short Peptide
RWKKFKKIPKFLKAAKKF

SEQ ID NO: 2729 - protein, 18 aa, Artificial
  Short Peptide
FWKKFKKIPKFLKAAKKF

SEQ ID NO: 2730 - protein, 18 aa, Artificial
  Short Peptide
KKKLLKKIPKFLKAAKKF

SEQ ID NO: 2731 - protein, 18 aa, Artificial
  Short Peptide
RKKLLKKIPKFLKAAKKF

SEQ ID NO: 2732 - protein, 18 aa, Artificial
  Short Peptide
FKKLLKKIPKFLKAAKKF

SEQ ID NO: 2733 - protein, 18 aa, Artificial
  Short Peptide
KWKLLKKIPKFLKAAKKF

SEQ ID NO: 2734 - protein, 18 aa, Artificial
  Short Peptide
RWKLLKKIPKFLKAAKKF

SEQ ID NO: 2735 - protein, 18 aa, Artificial
  Short Peptide
FWKLLKKIPKFLKAAKKF

SEQ ID NO: 2736 - protein, 18 aa, Artificial
  Short Peptide
KKKKLKKIPKFLKAAKKF

SEQ ID NO: 2737 - protein, 18 aa, Artificial
  Short Peptide
RKKKLKKIPKFLKAAKKF

SEQ ID NO: 2738 - protein, 18 aa, Artificial
  Short Peptide
FKKKLKKIPKFLKAAKKF

SEQ ID NO: 2739 - protein, 18 aa, Artificial
  Short Peptide
KWKKLKKIPKFLKAAKKF

SEQ ID NO: 2740 - protein, 18 aa, Artificial
  Short Peptide
RWKKLKKIPKFLKAAKKF

SEQ ID NO: 2741 - protein, 18 aa, Artificial
  Short Peptide
FWKKLKKIPKFLKAAKKF

SEQ ID NO: 2742 - protein, 20 aa, Artificial
  Short Peptide
KKKLFLKIPPPKFKKAAKKF

SEQ ID NO: 2743 - protein, 20 aa, Artificial
  Short Peptide
RKKLFLKIPPPKFKKAAKKF

SEQ ID NO: 2744 - protein, 20 aa, Artificial
  Short Peptide
FKKLFLKIPPPKFKKAAKKF

SEQ ID NO: 2745 - protein, 20 aa, Artificial
  Short Peptide
KWKLFLKIPPPKFKKAAKKF

SEQ ID NO: 2746 - protein, 20 aa, Artificial
  Short Peptide
RWKLFLKIPPPKFKKAAKKF

SEQ ID NO: 2747 - protein, 20 aa, Artificial
  Short Peptide
FWKLFLKIPPPKFKKAAKKF

SEQ ID NO: 2748 - protein, 20 aa, Artificial
  Short Peptide
KKKKFLKIPPPKFKKAAKKF

SEQ ID NO: 2749 - protein, 20 aa, Artificial
  Short Peptide
RKKKFLKIPPPKFKKAAKKF

SEQ ID NO: 2750 - protein, 20 aa, Artificial
  Short Peptide
FKKKFLKIPPPKFKKAAKKF

SEQ ID NO: 2751 - protein, 20 aa, Artificial
  Short Peptide
KWKKFLKIPPPKFKKAAKKF

SEQ ID NO: 2752 - protein, 20 aa, Artificial
  Short Peptide
RWKKFLKIPPPKFKKAAKKF

SEQ ID NO: 2753 - protein, 20 aa, Artificial
  Short Peptide
FWKKFLKIPPPKFKKAAKKF

SEQ ID NO: 2754 - protein, 20 aa, Artificial
  Short Peptide
KKKLLLKIPPPKFKKAAKKF

SEQ ID NO: 2755 - protein, 20 aa, Artificial
  Short Peptide
RKKLLLKIPPPKFKKAAKKF

SEQ ID NO: 2756 - protein, 20 aa, Artificial
  Short Peptide
FKKLLLKIPPPKFKKAAKKF

SEQ ID NO: 2757 - protein, 20 aa, Artificial
  Short Peptide
KWKLLLKIPPPKFKKAAKKF

SEQ ID NO: 2758 - protein, 20 aa, Artificial
  Short Peptide
RWKLLLKIPPPKFKKAAKKF

SEQ ID NO: 2759 - protein, 20 aa, Artificial
  Short Peptide
FWKLLLKIPPPKFKKAAKKF

SEQ ID NO: 2760 - protein, 20 aa, Artificial
  Short Peptide
KKKKLLKIPPPKFKKAAKKF

SEQ ID NO: 2761 - protein, 20 aa, Artificial
  Short Peptide
RKKKLLKIPPPKFKKAAKKF

SEQ ID NO: 2762 - protein, 20 aa, Artificial
  Short Peptide
FKKKLLKIPPPKFKKAAKKF

SEQ ID NO: 2763 - protein, 20 aa, Artificial
  Short Peptide
KWKKLLKIPPPKFKKAAKKF

SEQ ID NO: 2764 - protein, 20 aa, Artificial
  Short Peptide
RWKKLLKIPPPKFKKAAKKF

SEQ ID NO: 2765 - protein, 20 aa, Artificial
  Short Peptide
FWKKLLKIPPPKFKKAAKKF

SEQ ID NO: 2766 - protein, 20 aa, Artificial
  Short Peptide
KKKLFKKIPPPKFKKAAKKF

SEQ ID NO: 2767 - protein, 20 aa, Artificial
  Short Peptide
RKKLFKKIPPPKFKKAAKKF

SEQ ID NO: 2768 - protein, 20 aa, Artificial
  Short Peptide
FKKLFKKIPPPKFKKAAKKF

SEQ ID NO: 2769 - protein, 20 aa, Artificial
  Short Peptide
KWKLFKKIPPPKFKKAAKKF

SEQ ID NO: 2770 - protein, 20 aa, Artificial
  Short Peptide
RWKLFKKIPPPKFKKAAKKF

SEQ ID NO: 2771 - protein, 20 aa, Artificial
  Short Peptide
FWKLFKKIPPPKFKKAAKKF

SEQ ID NO: 2772 - protein, 20 aa, Artificial
  Short Peptide
KKKKFKKIPPPKFKKAAKKF

SEQ ID NO: 2773 - protein, 20 aa, Artificial
  Short Peptide
RKKKFKKIPPPKFKKAAKKF

SEQ ID NO: 2774 - protein, 20 aa, Artificial
  Short Peptide
FKKKFKKIPPPKFKKAAKKF

SEQ ID NO: 2775 - protein, 20 aa, Artificial
  Short Peptide
KWKKFKKIPPPKFKKAAKKF

SEQ ID NO: 2776 - protein, 20 aa, Artificial
  Short Peptide
RWKKFKKIPPPKFKKAAKKF

SEQ ID NO: 2777 - protein, 20 aa, Artificial
  Short Peptide
FWKKFKKIPPPKFKKAAKKF

SEQ ID NO: 2778 - protein, 20 aa, Artificial
  Short Peptide
KKKLLKKIPPPKFKKAAKKF

SEQ ID NO: 2779 - protein, 20 aa, Artificial
  Short Peptide
RKKLLKKIPPPKFKKAAKKF

SEQ ID NO: 2780 - protein, 20 aa, Artificial
  Short Peptide
FKKLLKKIPPPKFKKAAKKF

SEQ ID NO: 2781 - protein, 20 aa, Artificial
  Short Peptide
KWKLLKKIPPPKFKKAAKKF

SEQ ID NO: 2782 - protein, 20 aa, Artificial
  Short Peptide
RWKLLKKIPPPKFKKAAKKF

SEQ ID NO: 2783 - protein, 20 aa, Artificial
  Short Peptide
FWKLLKKIPPPKFKKAAKKF

SEQ ID NO: 2784 - protein, 20 aa, Artificial
  Short Peptide
KKKKLKKIPPPKFKKAAKKF

SEQ ID NO: 2785 - protein, 20 aa, Artificial
  Short Peptide
RKKKLKKIPPPKFKKAAKKF

SEQ ID NO: 2786 - protein, 20 aa, Artificial
  Short Peptide
FKKKLKKIPPPKFKKAAKKF

SEQ ID NO: 2787 - protein, 20 aa, Artificial
  Short Peptide
KWKKLKKIPPPKFKKAAKKF

SEQ ID NO: 2788 - protein, 20 aa, Artificial
  Short Peptide
RWKKLKKIPPPKFKKAAKKF

SEQ ID NO: 2789 - protein, 20 aa, Artificial
  Short Peptide
FWKKLKKIPPPKFKKAAKKF

SEQ ID NO: 2790 - protein, 19 aa, Artificial
  Short Peptide
KKKLFLKIPPKFKKAAKKF

SEQ ID NO: 2791 - protein, 19 aa, Artificial
  Short Peptide
RKKLFLKIPPKFKKAAKKF

SEQ ID NO: 2792 - protein, 19 aa, Artificial
  Short Peptide
FKKLFLKIPPKFKKAAKKF

SEQ ID NO: 2793 - protein, 19 aa, Artificial
  Short Peptide
KWKLFLKIPPKFKKAAKKF

SEQ ID NO: 2794 - protein, 19 aa, Artificial
  Short Peptide
RWKLFLKIPPKFKKAAKKF

SEQ ID NO: 2795 - protein, 19 aa, Artificial
  Short Peptide
FWKLFLKIPPKFKKAAKKF

SEQ ID NO: 2796 - protein, 19 aa, Artificial
  Short Peptide
KKKKFLKIPPKFKKAAKKF

SEQ ID NO: 2797 - protein, 19 aa, Artificial
  Short Peptide
RKKKFLKIPPKFKKAAKKF

SEQ ID NO: 2798 - protein, 19 aa, Artificial
  Short Peptide
FKKKFLKIPPKFKKAAKKF

SEQ ID NO: 2799 - protein, 19 aa, Artificial
  Short Peptide
KWKKFLKIPPKFKKAAKKF

SEQ ID NO: 2800 - protein, 19 aa, Artificial
  Short Peptide
RWKKFLKIPPKFKKAAKKF

SEQ ID NO: 2801 - protein, 19 aa, Artificial
  Short Peptide
FWKKFLKIPPKFKKAAKKF

SEQ ID NO: 2802 - protein, 19 aa, Artificial
  Short Peptide
KKKLLLKIPPKFKKAAKKF

SEQ ID NO: 2803 - protein, 19 aa, Artificial
  Short Peptide
RKKLLLKIPPKFKKAAKKF

SEQ ID NO: 2804 - protein, 19 aa, Artificial
  Short Peptide
FKKLLLKIPPKFKKAAKKF

SEQ ID NO: 2805 - protein, 19 aa, Artificial
  Short Peptide
KWKLLLKIPPKFKKAAKKF

SEQ ID NO: 2806 - protein, 19 aa, Artificial
  Short Peptide
RWKLLLKIPPKFKKAAKKF

SEQ ID NO: 2807 - protein, 19 aa, Artificial
  Short Peptide
FWKLLLKIPPKFKKAAKKF

SEQ ID NO: 2808 - protein, 19 aa, Artificial
  Short Peptide
KKKKLLKIPPKFKKAAKKF

SEQ ID NO: 2809 - protein, 19 aa, Artificial
  Short Peptide
RKKKLLKIPPKFKKAAKKF

SEQ ID NO: 2810 - protein, 19 aa, Artificial
  Short Peptide
FKKKLLKIPPKFKKAAKKF

SEQ ID NO: 2811 - protein, 19 aa, Artificial
  Short Peptide
KWKKLLKIPPKFKKAAKKF

SEQ ID NO: 2812 - protein, 19 aa, Artificial
  Short Peptide
RWKKLLKIPPKFKKAAKKF

SEQ ID NO: 2813 - protein, 19 aa, Artificial
  Short Peptide
FWKKLLKIPPKFKKAAKKF

SEQ ID NO: 2814 - protein, 19 aa, Artificial
  Short Peptide
KKKLFKKIPPKFKKAAKKF

SEQ ID NO: 2815 - protein, 19 aa, Artificial
  Short Peptide
RKKLFKKIPPKFKKAAKKF

SEQ ID NO: 2816 - protein, 19 aa, Artificial
  Short Peptide
FKKLFKKIPPKFKKAAKKF

SEQ ID NO: 2817 - protein, 19 aa, Artificial
  Short Peptide
KWKLFKKIPPKFKKAAKKF

SEQ ID NO: 2818 - protein, 19 aa, Artificial
  Short Peptide
RWKLFKKIPPKFKKAAKKF

SEQ ID NO: 2819 - protein, 19 aa, Artificial
  Short Peptide
FWKLFKKIPPKFKKAAKKF

SEQ ID NO: 2820 - protein, 19 aa, Artificial
  Short Peptide
KKKKFKKIPPKFKKAAKKF

SEQ ID NO: 2821 - protein, 19 aa, Artificial
  Short Peptide
RKKKFKKIPPKFKKAAKKF

SEQ ID NO: 2822 - protein, 19 aa, Artificial
  Short Peptide
FKKKFKKIPPKFKKAAKKF

SEQ ID NO: 2823 - protein, 19 aa, Artificial
  Short Peptide
KWKKFKKIPPKFKKAAKKF

SEQ ID NO: 2824 - protein, 19 aa, Artificial
  Short Peptide
RWKKFKKIPPKFKKAAKKF

SEQ ID NO: 2825 - protein, 19 aa, Artificial
  Short Peptide
FWKKFKKIPPKFKKAAKKF

SEQ ID NO: 2826 - protein, 19 aa, Artificial
  Short Peptide
KKKLLKKIPPKFKKAAKKF

SEQ ID NO: 2827 - protein, 19 aa, Artificial
  Short Peptide
RKKLLKKIPPKFKKAAKKF

SEQ ID NO: 2828 - protein, 19 aa, Artificial
  Short Peptide
FKKLLKKIPPKFKKAAKKF

SEQ ID NO: 2829 - protein, 19 aa, Artificial
  Short Peptide
KWKLLKKIPPKFKKAAKKF

SEQ ID NO: 2830 - protein, 19 aa, Artificial
  Short Peptide
RWKLLKKIPPKFKKAAKKF

SEQ ID NO: 2831 - protein, 19 aa, Artificial
  Short Peptide
FWKLLKKIPPKFKKAAKKF

SEQ ID NO: 2832 - protein, 19 aa, Artificial
  Short Peptide
KKKKLKKIPPKFKKAAKKF

SEQ ID NO: 2833 - protein, 19 aa, Artificial
  Short Peptide
RKKKLKKIPPKFKKAAKKF

SEQ ID NO: 2834 - protein, 19 aa, Artificial
  Short Peptide
FKKKLKKIPPKFKKAAKKF

SEQ ID NO: 2835 - protein, 19 aa, Artificial
  Short Peptide
KWKKLKKIPPKFKKAAKKF

SEQ ID NO: 2836 - protein, 19 aa, Artificial
  Short Peptide
RWKKLKKIPPKFKKAAKKF

SEQ ID NO: 2837 - protein, 19 aa, Artificial
  Short Peptide
FWKKLKKIPPKFKKAAKKF

SEQ ID NO: 2838 - protein, 18 aa, Artificial
  Short Peptide
KKKLFLKIPKFKKAAKKF

SEQ ID NO: 2839 - protein, 18 aa, Artificial
  Short Peptide
RKKLFLKIPKFKKAAKKF

SEQ ID NO: 2840 - protein, 18 aa, Artificial
  Short Peptide
FKKLFLKIPKFKKAAKKF

SEQ ID NO: 2841 - protein, 18 aa, Artificial
  Short Peptide
KWKLFLKIPKFKKAAKKF

SEQ ID NO: 2842 - protein, 18 aa, Artificial
  Short Peptide
RWKLFLKIPKFKKAAKKF

SEQ ID NO: 2843 - protein, 18 aa, Artificial
  Short Peptide
FWKLFLKIPKFKKAAKKF

SEQ ID NO: 2844 - protein, 18 aa, Artificial
  Short Peptide
KKKKFLKIPKFKKAAKKF

SEQ ID NO: 2845 - protein, 18 aa, Artificial
  Short Peptide
RKKKFLKIPKFKKAAKKF

SEQ ID NO: 2846 - protein, 18 aa, Artificial
  Short Peptide
FKKKFLKIPKFKKAAKKF

SEQ ID NO: 2847 - protein, 18 aa, Artificial
  Short Peptide
KWKKFLKIPKFKKAAKKF

SEQ ID NO: 2848 - protein, 18 aa, Artificial
  Short Peptide
RWKKFLKIPKFKKAAKKF

SEQ ID NO: 2849 - protein, 18 aa, Artificial
  Short Peptide
FWKKFLKIPKFKKAAKKF

SEQ ID NO: 2850 - protein, 18 aa, Artificial
  Short Peptide
KKKLLLKIPKFKKAAKKF

SEQ ID NO: 2851 - protein, 18 aa, Artificial
  Short Peptide
RKKLLLKIPKFKKAAKKF

SEQ ID NO: 2852 - protein, 18 aa, Artificial
  Short Peptide
FKKLLLKIPKFKKAAKKF

SEQ ID NO: 2853 - protein, 18 aa, Artificial
  Short Peptide
KWKLLLKIPKFKKAAKKF

SEQ ID NO: 2854 - protein, 18 aa, Artificial
  Short Peptide
RWKLLLKIPKFKKAAKKF

SEQ ID NO: 2855 - protein, 18 aa, Artificial
  Short Peptide
FWKLLLKIPKFKKAAKKF

SEQ ID NO: 2856 - protein, 18 aa, Artificial
  Short Peptide
KKKKLLKIPKFKKAAKKF

SEQ ID NO: 2857 - protein, 18 aa, Artificial
  Short Peptide
RKKKLLKIPKFKKAAKKF

SEQ ID NO: 2858 - protein, 18 aa, Artificial
  Short Peptide
FKKKLLKIPKFKKAAKKF

SEQ ID NO: 2859 - protein, 18 aa, Artificial
  Short Peptide
KWKKLLKIPKFKKAAKKF

SEQ ID NO: 2860 - protein, 18 aa, Artificial
  Short Peptide
RWKKLLKIPKFKKAAKKF

SEQ ID NO: 2861 - protein, 18 aa, Artificial
  Short Peptide
FWKKLLKIPKFKKAAKKF

SEQ ID NO: 2862 - protein, 18 aa, Artificial
  Short Peptide
KKKLFKKIPKFKKAAKKF

SEQ ID NO: 2863 - protein, 18 aa, Artificial
  Short Peptide
RKKLFKKIPKFKKAAKKF

SEQ ID NO: 2864 - protein, 18 aa, Artificial
  Short Peptide
FKKLFKKIPKFKKAAKKF

SEQ ID NO: 2865 - protein, 18 aa, Artificial
  Short Peptide
KWKLFKKIPKFKKAAKKF

SEQ ID NO: 2866 - protein, 18 aa, Artificial
  Short Peptide
RWKLFKKIPKFKKAAKKF

SEQ ID NO: 2867 - protein, 18 aa, Artificial
  Short Peptide
FWKLFKKIPKFKKAAKKF

SEQ ID NO: 2868 - protein, 18 aa, Artificial
  Short Peptide
KKKKFKKIPKFKKAAKKF

SEQ ID NO: 2869 - protein, 18 aa, Artificial
  Short Peptide
RKKKFKKIPKFKKAAKKF

SEQ ID NO: 2870 - protein, 18 aa, Artificial
  Short Peptide
FKKKFKKIPKFKKAAKKF

SEQ ID NO: 2871 - protein, 18 aa, Artificial
  Short Peptide
KWKKFKKIPKFKKAAKKF

SEQ ID NO: 2872 - protein, 18 aa, Artificial
  Short Peptide
RWKKFKKIPKFKKAAKKF

SEQ ID NO: 2873 - protein, 18 aa, Artificial
  Short Peptide
FWKKFKKIPKFKKAAKKF

SEQ ID NO: 2874 - protein, 18 aa, Artificial
  Short Peptide
KKKLLKKIPKFKKAAKKF

SEQ ID NO: 2875 - protein, 18 aa, Artificial
  Short Peptide
RKKLLKKIPKFKKAAKKF

SEQ ID NO: 2876 - protein, 18 aa, Artificial
  Short Peptide
FKKLLKKIPKFKKAAKKF

SEQ ID NO: 2877 - protein, 18 aa, Artificial
  Short Peptide
KWKLLKKIPKFKKAAKKF

SEQ ID NO: 2878 - protein, 18 aa, Artificial
  Short Peptide
RWKLLKKIPKFKKAAKKF

SEQ ID NO: 2879 - protein, 18 aa, Artificial
  Short Peptide
FWKLLKKIPKFKKAAKKF

SEQ ID NO: 2880 - protein, 18 aa, Artificial
  Short Peptide
KKKKLKKIPKFKKAAKKF

SEQ ID NO: 2881 - protein, 18 aa, Artificial
  Short Peptide
RKKKLKKIPKFKKAAKKF

SEQ ID NO: 2882 - protein, 18 aa, Artificial
  Short Peptide
FKKKLKKIPKFKKAAKKF

SEQ ID NO: 2883 - protein, 18 aa, Artificial
  Short Peptide
KWKKLKKIPKFKKAAKKF

SEQ ID NO: 2884 - protein, 18 aa, Artificial
  Short Peptide
RWKKLKKIPKFKKAAKKF

SEQ ID NO: 2885 - protein, 18 aa, Artificial
  Short Peptide
FWKKLKKIPKFKKAAKKF

SEQ ID NO: 2886 - protein, 20 aa, Artificial
  Short Peptide
KKKLFLKIPPPKFLHLAKKF

SEQ ID NO: 2887 - protein, 20 aa, Artificial
  Short Peptide
RKKLFLKIPPPKFLHLAKKF

SEQ ID NO: 2888 - protein, 20 aa, Artificial
  Short Peptide
FKKLFLKIPPPKFLHLAKKF

SEQ ID NO: 2889 - protein, 20 aa, Artificial
  Short Peptide
KWKLFLKIPPPKFLHLAKKF

SEQ ID NO: 2890 - protein, 20 aa, Artificial
  Short Peptide
RWKLFLKIPPPKFLHLAKKF

SEQ ID NO: 2891 - protein, 20 aa, Artificial
  Short Peptide
FWKLFLKIPPPKFLHLAKKF

SEQ ID NO: 2892 - protein, 20 aa, Artificial
  Short Peptide
KKKKFLKIPPPKFLHLAKKF

SEQ ID NO: 2893 - protein, 20 aa, Artificial
  Short Peptide
RKKKFLKIPPPKFLHLAKKF

SEQ ID NO: 2894 - protein, 20 aa, Artificial
  Short Peptide
FKKKFLKIPPPKFLHLAKKF

SEQ ID NO: 2895 - protein, 20 aa, Artificial
  Short Peptide
KWKKFLKIPPPKFLHLAKKF

SEQ ID NO: 2896 - protein, 20 aa, Artificial
  Short Peptide
RWKKFLKIPPPKFLHLAKKF

SEQ ID NO: 2897 - protein, 20 aa, Artificial
  Short Peptide
FWKKFLKIPPPKFLHLAKKF

SEQ ID NO: 2898 - protein, 20 aa, Artificial
  Short Peptide
KKKLLLKIPPPKFLHLAKKF

SEQ ID NO: 2899 - protein, 20 aa, Artificial
  Short Peptide
RKKLLLKIPPPKFLHLAKKF

SEQ ID NO: 2900 - protein, 20 aa, Artificial
  Short Peptide
FKKLLLKIPPPKFLHLAKKF

SEQ ID NO: 2901 - protein, 20 aa, Artificial
  Short Peptide
KWKLLLKIPPPKFLHLAKKF

SEQ ID NO: 2902 - protein, 20 aa, Artificial
  Short Peptide
RWKLLLKIPPPKFLHLAKKF

SEQ ID NO: 2903 - protein, 20 aa, Artificial
  Short Peptide
FWKLLLKIPPPKFLHLAKKF

SEQ ID NO: 2904 - protein, 20 aa, Artificial
  Short Peptide
KKKKLLKIPPPKFLHLAKKF

SEQ ID NO: 2905 - protein, 20 aa, Artificial
  Short Peptide
RKKKLLKIPPPKFLHLAKKF

SEQ ID NO: 2906 - protein, 20 aa, Artificial
  Short Peptide
FKKKLLKIPPPKFLHLAKKF

SEQ ID NO: 2907 - protein, 20 aa, Artificial
  Short Peptide
KWKKLLKIPPPKFLHLAKKF

SEQ ID NO: 2908 - protein, 20 aa, Artificial
  Short Peptide
RWKKLLKIPPPKFLHLAKKF

SEQ ID NO: 2909 - protein, 20 aa, Artificial
  Short Peptide
FWKKLLKIPPPKFLHLAKKF

SEQ ID NO: 2910 - protein, 20 aa, Artificial
  Short Peptide
KKKLFKKIPPPKFLHLAKKF

SEQ ID NO: 2911 - protein, 20 aa, Artificial
  Short Peptide
RKKLFKKIPPPKFLHLAKKF

SEQ ID NO: 2912 - protein, 20 aa, Artificial
  Short Peptide
FKKLFKKIPPPKFLHLAKKF

SEQ ID NO: 2913 - protein, 20 aa, Artificial
  Short Peptide
KWKLFKKIPPPKFLHLAKKF

SEQ ID NO: 2914 - protein, 20 aa, Artificial
  Short Peptide
RWKLFKKIPPPKFLHLAKKF

SEQ ID NO: 2915 - protein, 20 aa, Artificial
  Short Peptide
FWKLFKKIPPPKFLHLAKKF

SEQ ID NO: 2916 - protein, 20 aa, Artificial
  Short Peptide
KKKKFKKIPPPKFLHLAKKF

SEQ ID NO: 2917 - protein, 20 aa, Artificial
  Short Peptide
RKKKFKKIPPPKFLHLAKKF

SEQ ID NO: 2918 - protein, 20 aa, Artificial
  Short Peptide
FKKKFKKIPPPKFLHLAKKF

SEQ ID NO: 2919 - protein, 20 aa, Artificial
  Short Peptide
KWKKFKKIPPPKFLHLAKKF

SEQ ID NO: 2920 - protein, 20 aa, Artificial
  Short Peptide
RWKKFKKIPPPKFLHLAKKF

SEQ ID NO: 2921 - protein, 20 aa, Artificial
  Short Peptide
FWKKFKKIPPPKFLHLAKKF

SEQ ID NO: 2922 - protein, 20 aa, Artificial
  Short Peptide
KKKLLKKIPPPKFLHLAKKF

SEQ ID NO: 2923 - protein, 20 aa, Artificial
  Short Peptide
RKKLLKKIPPPKFLHLAKKF

SEQ ID NO: 2924 - protein, 20 aa, Artificial
  Short Peptide
FKKLLKKIPPPKFLHLAKKF

SEQ ID NO: 2925 - protein, 20 aa, Artificial
  Short Peptide
KWKLLKKIPPPKFLHLAKKF

SEQ ID NO: 2926 - protein, 20 aa, Artificial
  Short Peptide
RWKLLKKIPPPKFLHLAKKF

SEQ ID NO: 2927 - protein, 20 aa, Artificial
  Short Peptide
FWKLLKKIPPPKFLHLAKKF

SEQ ID NO: 2928 - protein, 20 aa, Artificial
  Short Peptide
KKKKLKKIPPPKFLHLAKKF

SEQ ID NO: 2929 - protein, 20 aa, Artificial
  Short Peptide
RKKKLKKIPPPKFLHLAKKF

SEQ ID NO: 2930 - protein, 20 aa, Artificial
  Short Peptide
FKKKLKKIPPPKFLHLAKKF

SEQ ID NO: 2931 - protein, 20 aa, Artificial
  Short Peptide
KWKKLKKIPPPKFLHLAKKF

SEQ ID NO: 2932 - protein, 20 aa, Artificial
  Short Peptide
RWKKLKKIPPPKFLHLAKKF

SEQ ID NO: 2933 - protein, 20 aa, Artificial
  Short Peptide
FWKKLKKIPPPKFLHLAKKF

SEQ ID NO: 2934 - protein, 19 aa, Artificial
  Short Peptide
KKKLFLKIPPKFLHLAKKF

SEQ ID NO: 2935 - protein, 19 aa, Artificial
  Short Peptide
RKKLFLKIPPKFLHLAKKF

SEQ ID NO: 2936 - protein, 19 aa, Artificial
  Short Peptide
FKKLFLKIPPKFLHLAKKF

SEQ ID NO: 2937 - protein, 19 aa, Artificial
  Short Peptide
KWKLFLKIPPKFLHLAKKF

SEQ ID NO: 2938 - protein, 19 aa, Artificial
  Short Peptide
RWKLFLKIPPKFLHLAKKF

SEQ ID NO: 2939 - protein, 19 aa, Artificial
  Short Peptide
FWKLFLKIPPKFLHLAKKF

SEQ ID NO: 2940 - protein, 19 aa, Artificial
  Short Peptide
KKKKFLKIPPKFLHLAKKF

SEQ ID NO: 2941 - protein, 19 aa, Artificial
  Short Peptide
RKKKFLKIPPKFLHLAKKF

SEQ ID NO: 2942 - protein, 19 aa, Artificial
  Short Peptide
FKKKFLKIPPKFLHLAKKF

SEQ ID NO: 2943 - protein, 19 aa, Artificial
  Short Peptide
KWKKFLKIPPKFLHLAKKF

SEQ ID NO: 2944 - protein, 19 aa, Artificial
  Short Peptide
RWKKFLKIPPKFLHLAKKF

SEQ ID NO: 2945 - protein, 19 aa, Artificial
  Short Peptide
FWKKFLKIPPKFLHLAKKF

SEQ ID NO: 2946 - protein, 19 aa, Artificial
  Short Peptide
KKKLLLKIPPKFLHLAKKF

SEQ ID NO: 2947 - protein, 19 aa, Artificial
  Short Peptide
RKKLLLKIPPKFLHLAKKF

SEQ ID NO: 2948 - protein, 19 aa, Artificial
  Short Peptide
FKKLLLKIPPKFLHLAKKF

SEQ ID NO: 2949 - protein, 19 aa, Artificial
  Short Peptide
KWKLLLKIPPKFLHLAKKF

SEQ ID NO: 2950 - protein, 19 aa, Artificial
  Short Peptide
RWKLLLKIPPKFLHLAKKF

SEQ ID NO: 2951 - protein, 19 aa, Artificial
  Short Peptide
FWKLLLKIPPKFLHLAKKF

SEQ ID NO: 2952 - protein, 19 aa, Artificial
  Short Peptide
KKKKLLKIPPKFLHLAKKF

SEQ ID NO: 2953 - protein, 19 aa, Artificial
  Short Peptide
RKKKLLKIPPKFLHLAKKF

SEQ ID NO: 2954 - protein, 19 aa, Artificial
  Short Peptide
FKKKLLKIPPKFLHLAKKF

SEQ ID NO: 2955 - protein, 19 aa, Artificial
  Short Peptide
KWKKLLKIPPKFLHLAKKF

SEQ ID NO: 2956 - protein, 19 aa, Artificial
  Short Peptide
RWKKLLKIPPKFLHLAKKF

SEQ ID NO: 2957 - protein, 19 aa, Artificial
  Short Peptide
FWKKLLKIPPKFLHLAKKF

SEQ ID NO: 2958 - protein, 19 aa, Artificial
  Short Peptide
KKKLFKKIPPKFLHLAKKF

SEQ ID NO: 2959 - protein, 19 aa, Artificial
  Short Peptide
RKKLFKKIPPKFLHLAKKF

SEQ ID NO: 2960 - protein, 19 aa, Artificial
  Short Peptide
FKKLFKKIPPKFLHLAKKF

SEQ ID NO: 2961 - protein, 19 aa, Artificial
  Short Peptide
KWKLFKKIPPKFLHLAKKF

SEQ ID NO: 2962 - protein, 19 aa, Artificial
  Short Peptide
RWKLFKKIPPKFLHLAKKF

SEQ ID NO: 2963 - protein, 19 aa, Artificial
  Short Peptide
FWKLFKKIPPKFLHLAKKF

SEQ ID NO: 2964 - protein, 19 aa, Artificial
  Short Peptide
KKKKFKKIPPKFLHLAKKF

SEQ ID NO: 2965 - protein, 19 aa, Artificial
  Short Peptide
RKKKFKKIPPKFLHLAKKF

SEQ ID NO: 2966 - protein, 19 aa, Artificial
  Short Peptide
FKKKFKKIPPKFLHLAKKF

SEQ ID NO: 2967 - protein, 19 aa, Artificial
  Short Peptide
KWKKFKKIPPKFLHLAKKF

SEQ ID NO: 2968 - protein, 19 aa, Artificial
  Short Peptide
RWKKFKKIPPKFLHLAKKF

SEQ ID NO: 2969 - protein, 19 aa, Artificial
  Short Peptide
FWKKFKKIPPKFLHLAKKF

SEQ ID NO: 2970 - protein, 19 aa, Artificial
  Short Peptide
KKKLLKKIPPKFLHLAKKF

SEQ ID NO: 2971 - protein, 19 aa, Artificial
  Short Peptide
RKKLLKKIPPKFLHLAKKF

SEQ ID NO: 2972 - protein, 19 aa, Artificial
  Short Peptide
FKKLLKKIPPKFLHLAKKF

SEQ ID NO: 2973 - protein, 19 aa, Artificial
  Short Peptide
KWKLLKKIPPKFLHLAKKF

SEQ ID NO: 2974 - protein, 19 aa, Artificial
  Short Peptide
RWKLLKKIPPKFLHLAKKF

SEQ ID NO: 2975 - protein, 19 aa, Artificial
  Short Peptide
FWKLLKKIPPKFLHLAKKF

SEQ ID NO: 2976 - protein, 19 aa, Artificial
  Short Peptide
KKKKLKKIPPKFLHLAKKF

SEQ ID NO: 2977 - protein, 19 aa, Artificial
  Short Peptide
RKKKLKKIPPKFLHLAKKF

SEQ ID NO: 2978 - protein, 19 aa, Artificial
  Short Peptide
FKKKLKKIPPKFLHLAKKF

SEQ ID NO: 2979 - protein, 19 aa, Artificial
  Short Peptide
KWKKLKKIPPKFLHLAKKF

SEQ ID NO: 2980 - protein, 19 aa, Artificial
  Short Peptide
RWKKLKKIPPKFLHLAKKF

SEQ ID NO: 2981 - protein, 19 aa, Artificial
  Short Peptide
FWKKLKKIPPKFLHLAKKF

SEQ ID NO: 2982 - protein, 18 aa, Artificial
  Short Peptide
KKKLFLKIPKFLHLAKKF

SEQ ID NO: 2983 - protein, 18 aa, Artificial
  Short Peptide
RKKLFLKIPKFLHLAKKF

SEQ ID NO: 2984 - protein, 18 aa, Artificial
  Short Peptide
FKKLFLKIPKFLHLAKKF

SEQ ID NO: 2985 - protein, 18 aa, Artificial
  Short Peptide
KWKLFLKIPKFLHLAKKF

SEQ ID NO: 2986 - protein, 18 aa, Artificial
  Short Peptide
RWKLFLKIPKFLHLAKKF

SEQ ID NO: 2987 - protein, 18 aa, Artificial
  Short Peptide
FWKLFLKIPKFLHLAKKF

SEQ ID NO: 2988 - protein, 18 aa, Artificial
  Short Peptide
KKKKFLKIPKFLHLAKKF

SEQ ID NO: 2989 - protein, 18 aa, Artificial
  Short Peptide
RKKKFLKIPKFLHLAKKF

SEQ ID NO: 2990 - protein, 18 aa, Artificial
  Short Peptide
FKKKFLKIPKFLHLAKKF

SEQ ID NO: 2991 - protein, 18 aa, Artificial
  Short Peptide
KWKKFLKIPKFLHLAKKF

SEQ ID NO: 2992 - protein, 18 aa, Artificial
  Short Peptide
RWKKFLKIPKFLHLAKKF

SEQ ID NO: 2993 - protein, 18 aa, Artificial
  Short Peptide
FWKKFLKIPKFLHLAKKF

SEQ ID NO: 2994 - protein, 18 aa, Artificial
  Short Peptide
KKKLLLKIPKFLHLAKKF

SEQ ID NO: 2995 - protein, 18 aa, Artificial
  Short Peptide
RKKLLLKIPKFLHLAKKF

SEQ ID NO: 2996 - protein, 18 aa, Artificial
  Short Peptide
FKKLLLKIPKFLHLAKKF

SEQ ID NO: 2997 - protein, 18 aa, Artificial
  Short Peptide
KWKLLLKIPKFLHLAKKF

SEQ ID NO: 2998 - protein, 18 aa, Artificial
  Short Peptide
RWKLLLKIPKFLHLAKKF

SEQ ID NO: 2999 - protein, 18 aa, Artificial
  Short Peptide
FWKLLLKIPKFLHLAKKF

SEQ ID NO: 3000 - protein, 18 aa, Artificial
  Short Peptide
KKKKLLKIPKFLHLAKKF

SEQ ID NO: 3001 - protein, 18 aa, Artificial
  Short Peptide
RKKKLLKIPKFLHLAKKF

SEQ ID NO: 3002 - protein, 18 aa, Artificial
  Short Peptide
FKKKLLKIPKFLHLAKKF

SEQ ID NO: 3003 - protein, 18 aa, Artificial
  Short Peptide
KWKKLLKIPKFLHLAKKF

SEQ ID NO: 3004 - protein, 18 aa, Artificial
  Short Peptide
RWKKLLKIPKFLHLAKKF

SEQ ID NO: 3005 - protein, 18 aa, Artificial
  Short Peptide
FWKKLLKIPKFLHLAKKF

SEQ ID NO: 3006 - protein, 18 aa, Artificial
  Short Peptide
KKKLFKKIPKFLHLAKKF

SEQ ID NO: 3007 - protein, 18 aa, Artificial
  Short Peptide
RKKLFKKIPKFLHLAKKF

SEQ ID NO: 3008 - protein, 18 aa, Artificial
  Short Peptide
FKKLFKKIPKFLHLAKKF

SEQ ID NO: 3009 - protein, 18 aa, Artificial
  Short Peptide
FWKLFKKIPKFLHLAKKF

SEQ ID NO: 3010 - protein, 18 aa, Artificial
  Short Peptide
KKKKFKKIPKFLHLAKKF

SEQ ID NO: 3011 - protein, 18 aa, Artificial
  Short Peptide
RKKKFKKIPKFLHLAKKF

SEQ ID NO: 3012 - protein, 18 aa, Artificial
  Short Peptide
FKKKFKKIPKFLHLAKKF

SEQ ID NO: 3013 - protein, 18 aa, Artificial
  Short Peptide
KWKKFKKIPKFLHLAKKF

SEQ ID NO: 3014 - protein, 18 aa, Artificial
  Short Peptide
RWKKFKKIPKFLHLAKKF

SEQ ID NO: 3015 - protein, 18 aa, Artificial
  Short Peptide
FWKKFKKIPKFLHLAKKF

SEQ ID NO: 3016 - protein, 18 aa, Artificial
  Short Peptide
KKKLLKKIPKFLHLAKKF

SEQ ID NO: 3017 - protein, 18 aa, Artificial
  Short Peptide
RKKLLKKIPKFLHLAKKF

SEQ ID NO: 3018 - protein, 18 aa, Artificial
  Short Peptide
FKKLLKKIPKFLHLAKKF

SEQ ID NO: 3019 - protein, 18 aa, Artificial
  Short Peptide
KWKLLKKIPKFLHLAKKF

SEQ ID NO: 3020 - protein, 18 aa, Artificial
  Short Peptide
RWKLLKKIPKFLHLAKKF

SEQ ID NO: 3021 - protein, 18 aa, Artificial
  Short Peptide
FWKLLKKIPKFLHLAKKF

SEQ ID NO: 3022 - protein, 18 aa, Artificial
  Short Peptide
KKKKLKKIPKFLHLAKKF

SEQ ID NO: 3023 - protein, 18 aa, Artificial
  Short Peptide
RKKKLKKIPKFLHLAKKF

SEQ ID NO: 3024 - protein, 18 aa, Artificial
  Short Peptide
FKKKLKKIPKFLHLAKKF

SEQ ID NO: 3025 - protein, 18 aa, Artificial
  Short Peptide
KWKKLKKIPKFLHLAKKF

SEQ ID NO: 3026 - protein, 18 aa, Artificial
  Short Peptide
RWKKLKKIPKFLHLAKKF

SEQ ID NO: 3027 - protein, 18 aa, Artificial
  Short Peptide
FWKKLKKIPKFLHLAKKF

SEQ ID NO: 3028 - protein, 20 aa, Artificial
  Short Peptide
KKKLFLKIPPPKFKHLAKKF

SEQ ID NO: 3029 - protein, 20 aa, Artificial
  Short Peptide
RKKLFLKIPPPKFKHLAKKF

SEQ ID NO: 3030 - protein, 20 aa, Artificial
  Short Peptide
FKKLFLKIPPPKFKHLAKKF

SEQ ID NO: 3031 - protein, 20 aa, Artificial
  Short Peptide
KWKLFLKIPPPKFKHLAKKF

SEQ ID NO: 3032 - protein, 20 aa, Artificial
  Short Peptide
RWKLFLKIPPPKFKHLAKKF

SEQ ID NO: 3033 - protein, 20 aa, Artificial
  Short Peptide
FWKLFLKIPPPKFKHLAKKF

SEQ ID NO: 3034 - protein, 20 aa, Artificial
  Short Peptide
KKKKFLKIPPPKFKHLAKKF

SEQ ID NO: 3035 - protein, 20 aa, Artificial
  Short Peptide
RKKKFLKIPPPKFKHLAKKF

SEQ ID NO: 3036 - protein, 20 aa, Artificial
  Short Peptide
FKKKFLKIPPPKFKHLAKKF

SEQ ID NO: 3037 - protein, 20 aa, Artificial
  Short Peptide
KWKKFLKIPPPKFKHLAKKF

SEQ ID NO: 3038 - protein, 20 aa, Artificial
  Short Peptide
RWKKFLKIPPPKFKHLAKKF

SEQ ID NO: 3039 - protein, 20 aa, Artificial
  Short Peptide
FWKKFLKIPPPKFKHLAKKF

SEQ ID NO: 3040 - protein, 20 aa, Artificial
  Short Peptide
KKKLLLKIPPPKFKHLAKKF

SEQ ID NO: 3041 - protein, 20 aa, Artificial
  Short Peptide
RKKLLLKIPPPKFKHLAKKF

SEQ ID NO: 3042 - protein, 20 aa, Artificial
  Short Peptide
FKKLLLKIPPPKFKHLAKKF

SEQ ID NO: 3043 - protein, 20 aa, Artificial
  Short Peptide
KWKLLLKIPPPKFKHLAKKF

SEQ ID NO: 3044 - protein, 20 aa, Artificial
  Short Peptide
RWKLLLKIPPPKFKHLAKKF

SEQ ID NO: 3045 - protein, 20 aa, Artificial
  Short Peptide
FWKLLLKIPPPKFKHLAKKF

SEQ ID NO: 3046 - protein, 20 aa, Artificial
  Short Peptide
KKKKLLKIPPPKFKHLAKKF

SEQ ID NO: 3047 - protein, 20 aa, Artificial
  Short Peptide
RKKKLLKIPPPKFKHLAKKF

SEQ ID NO: 3048 - protein, 20 aa, Artificial
  Short Peptide
FKKKLLKIPPPKFKHLAKKF

SEQ ID NO: 3049 - protein, 20 aa, Artificial
  Short Peptide
KWKKLLKIPPPKFKHLAKKF

SEQ ID NO: 3050 - protein, 20 aa, Artificial
  Short Peptide
RWKKLLKIPPPKFKHLAKKF

SEQ ID NO: 3051 - protein, 20 aa, Artificial
  Short Peptide
FWKKLLKIPPPKFKHLAKKF

SEQ ID NO: 3052 - protein, 20 aa, Artificial
  Short Peptide
KKKLFKKIPPPKFKHLAKKF

SEQ ID NO: 3053 - protein, 20 aa, Artificial
  Short Peptide
RKKLFKKIPPPKFKHLAKKF

SEQ ID NO: 3054 - protein, 20 aa, Artificial
  Short Peptide
FKKLFKKIPPPKFKHLAKKF

SEQ ID NO: 3055 - protein, 20 aa, Artificial
  Short Peptide
KWKLFKKIPPPKFKHLAKKF

SEQ ID NO: 3056 - protein, 20 aa, Artificial
  Short Peptide
RWKLFKKIPPPKFKHLAKKF

SEQ ID NO: 3057 - protein, 20 aa, Artificial
  Short Peptide
FWKLFKKIPPPKFKHLAKKF

SEQ ID NO: 3058 - protein, 20 aa, Artificial
  Short Peptide
KKKKFKKIPPPKFKHLAKKF

SEQ ID NO: 3059 - protein, 20 aa, Artificial
  Short Peptide
RKKKFKKIPPPKFKHLAKKF

SEQ ID NO: 3060 - protein, 20 aa, Artificial
  Short Peptide
FKKKFKKIPPPKFKHLAKKF

SEQ ID NO: 3061 - protein, 20 aa, Artificial
  Short Peptide
KWKKFKKIPPPKFKHLAKKF

SEQ ID NO: 3062 - protein, 20 aa, Artificial
  Short Peptide
RWKKFKKIPPPKFKHLAKKF

SEQ ID NO: 3063 - protein, 20 aa, Artificial
  Short Peptide
FWKKFKKIPPPKFKHLAKKF

SEQ ID NO: 3064 - protein, 20 aa, Artificial
  Short Peptide
KKKLLKKIPPPKFKHLAKKF

SEQ ID NO: 3065 - protein, 20 aa, Artificial
  Short Peptide
RKKLLKKIPPPKFKHLAKKF

SEQ ID NO: 3066 - protein, 20 aa, Artificial
  Short Peptide
FKKLLKKIPPPKFKHLAKKF

SEQ ID NO: 3067 - protein, 20 aa, Artificial
  Short Peptide
KWKLLKKIPPPKFKHLAKKF

SEQ ID NO: 3068 - protein, 20 aa, Artificial
  Short Peptide
RWKLLKKIPPPKFKHLAKKF

SEQ ID NO: 3069 - protein, 20 aa, Artificial
  Short Peptide
FWKLLKKIPPPKFKHLAKKF

SEQ ID NO: 3070 - protein, 20 aa, Artificial
  Short Peptide
KKKKLKKIPPPKFKHLAKKF

SEQ ID NO: 3071 - protein, 20 aa, Artificial
  Short Peptide
RKKKLKKIPPPKFKHLAKKF

SEQ ID NO: 3072 - protein, 20 aa, Artificial
  Short Peptide
FKKKLKKIPPPKFKHLAKKF

SEQ ID NO: 3073 - protein, 20 aa, Artificial
  Short Peptide
KWKKLKKIPPPKFKHLAKKF

SEQ ID NO: 3074 - protein, 20 aa, Artificial
  Short Peptide
RWKKLKKIPPPKFKHLAKKF

SEQ ID NO: 3075 - protein, 20 aa, Artificial
  Short Peptide
FWKKLKKIPPPKFKHLAKKF

SEQ ID NO: 3076 - protein, 19 aa, Artificial
  Short Peptide
KKKLFLKIPPKFKHLAKKF

SEQ ID NO: 3077 - protein, 19 aa, Artificial
  Short Peptide
RKKLFLKIPPKFKHLAKKF

SEQ ID NO: 3078 - protein, 19 aa, Artificial
  Short Peptide
FKKLFLKIPPKFKHLAKKF

SEQ ID NO: 3079 - protein, 19 aa, Artificial
  Short Peptide
KWKLFLKIPPKFKHLAKKF

SEQ ID NO: 3080 - protein, 19 aa, Artificial
  Short Peptide
RWKLFLKIPPKFKHLAKKF

SEQ ID NO: 3081 - protein, 19 aa, Artificial
  Short Peptide
FWKLFLKIPPKFKHLAKKF

SEQ ID NO: 3082 - protein, 19 aa, Artificial
  Short Peptide
KKKKFLKIPPKFKHLAKKF

SEQ ID NO: 3083 - protein, 19 aa, Artificial
  Short Peptide
RKKKFLKIPPKFKHLAKKF

SEQ ID NO: 3084 - protein, 19 aa, Artificial
  Short Peptide
FKKKFLKIPPKFKHLAKKF

SEQ ID NO: 3085 - protein, 19 aa, Artificial
  Short Peptide
KWKKFLKIPPKFKHLAKKF

SEQ ID NO: 3086 - protein, 19 aa, Artificial
  Short Peptide
RWKKFLKIPPKFKHLAKKF

SEQ ID NO: 3087 - protein, 19 aa, Artificial
  Short Peptide
FWKKFLKIPPKFKHLAKKF

SEQ ID NO: 3088 - protein, 19 aa, Artificial
  Short Peptide
KKKLLLKIPPKFKHLAKKF

SEQ ID NO: 3089 - protein, 19 aa, Artificial
  Short Peptide
RKKLLLKIPPKFKHLAKKF

SEQ ID NO: 3090 - protein, 19 aa, Artificial
  Short Peptide
FKKLLLKIPPKFKHLAKKF

SEQ ID NO: 3091 - protein, 19 aa, Artificial
  Short Peptide
KWKLLLKIPPKFKHLAKKF

SEQ ID NO: 3092 - protein, 19 aa, Artificial
  Short Peptide
RWKLLLKIPPKFKHLAKKF

SEQ ID NO: 3093 - protein, 19 aa, Artificial
  Short Peptide
FWKLLLKIPPKFKHLAKKF

SEQ ID NO: 3094 - protein, 19 aa, Artificial
  Short Peptide
KKKKLLKIPPKFKHLAKKF

SEQ ID NO: 3095 - protein, 19 aa, Artificial
  Short Peptide
RKKKLLKIPPKFKHLAKKF

SEQ ID NO: 3096 - protein, 19 aa, Artificial
  Short Peptide
FKKKLLKIPPKFKHLAKKF

SEQ ID NO: 3097 - protein, 19 aa, Artificial
  Short Peptide
KWKKLLKIPPKFKHLAKKF

SEQ ID NO: 3098 - protein, 19 aa, Artificial
  Short Peptide
RWKKLLKIPPKFKHLAKKF

SEQ ID NO: 3099 - protein, 19 aa, Artificial
  Short Peptide
FWKKLLKIPPKFKHLAKKF

SEQ ID NO: 3100 - protein, 19 aa, Artificial
  Short Peptide
KKKLFKKIPPKFKHLAKKF

SEQ ID NO: 3101 - protein, 19 aa, Artificial
  Short Peptide
RKKLFKKIPPKFKHLAKKF

SEQ ID NO: 3102 - protein, 19 aa, Artificial
  Short Peptide
FKKLFKKIPPKFKHLAKKF

SEQ ID NO: 3103 - protein, 19 aa, Artificial
  Short Peptide
KWKLFKKIPPKFKHLAKKF

SEQ ID NO: 3104 - protein, 19 aa, Artificial
  Short Peptide
RWKLFKKIPPKFKHLAKKF

SEQ ID NO: 3105 - protein, 19 aa, Artificial
  Short Peptide
FWKLFKKIPPKFKHLAKKF

SEQ ID NO: 3106 - protein, 19 aa, Artificial
  Short Peptide
KKKKFKKIPPKFKHLAKKF

SEQ ID NO: 3107 - protein, 19 aa, Artificial
  Short Peptide
RKKKFKKIPPKFKHLAKKF

SEQ ID NO: 3108 - protein, 19 aa, Artificial
  Short Peptide
FKKKFKKIPPKFKHLAKKF

SEQ ID NO: 3109 - protein, 19 aa, Artificial
  Short Peptide
KWKKFKKIPPKFKHLAKKF

SEQ ID NO: 3110 - protein, 19 aa, Artificial
  Short Peptide
RWKKFKKIPPKFKHLAKKF

SEQ ID NO: 3111 - protein, 19 aa, Artificial
  Short Peptide
FWKKFKKIPPKFKHLAKKF

SEQ ID NO: 3112 - protein, 19 aa, Artificial
  Short Peptide
KKKLLKKIPPKFKHLAKKF

SEQ ID NO: 3113 - protein, 19 aa, Artificial
  Short Peptide
RKKLLKKIPPKFKHLAKKF

SEQ ID NO: 3114 - protein, 19 aa, Artificial
  Short Peptide
FKKLLKKIPPKFKHLAKKF

SEQ ID NO: 3115 - protein, 19 aa, Artificial
  Short Peptide
KWKLLKKIPPKFKHLAKKF

SEQ ID NO: 3116 - protein, 19 aa, Artificial
  Short Peptide
RWKLLKKIPPKFKHLAKKF

SEQ ID NO: 3117 - protein, 19 aa, Artificial
  Short Peptide
FWKLLKKIPPKFKHLAKKF

SEQ ID NO: 3118 - protein, 19 aa, Artificial
  Short Peptide
KKKKLKKIPPKFKHLAKKF

SEQ ID NO: 3119 - protein, 19 aa, Artificial
  Short Peptide
RKKKLKKIPPKFKHLAKKF

SEQ ID NO: 3120 - protein, 19 aa, Artificial
  Short Peptide
FKKKLKKIPPKFKHLAKKF

SEQ ID NO: 3121 - protein, 19 aa, Artificial
  Short Peptide
KWKKLKKIPPKFKHLAKKF

SEQ ID NO: 3122 - protein, 19 aa, Artificial
  Short Peptide
RWKKLKKIPPKFKHLAKKF

SEQ ID NO: 3123 - protein, 19 aa, Artificial
  Short Peptide
FWKKLKKIPPKFKHLAKKF

SEQ ID NO: 3124 - protein, 18 aa, Artificial
  Short Peptide
KKKLFLKIPKFKHLAKKF

SEQ ID NO: 3125 - protein, 18 aa, Artificial
  Short Peptide
RKKLFLKIPKFKHLAKKF

SEQ ID NO: 3126 - protein, 18 aa, Artificial
  Short Peptide
FKKLFLKIPKFKHLAKKF

SEQ ID NO: 3127 - protein, 18 aa, Artificial
  Short Peptide
KWKLFLKIPKFKHLAKKF

SEQ ID NO: 3128 - protein, 18 aa, Artificial
  Short Peptide
RWKLFLKIPKFKHLAKKF

SEQ ID NO: 3129 - protein, 18 aa, Artificial
  Short Peptide
FWKLFLKIPKFKHLAKKF

SEQ ID NO: 3130 - protein, 18 aa, Artificial
  Short Peptide
KKKKFLKIPKFKHLAKKF

SEQ ID NO: 3131 - protein, 18 aa, Artificial
  Short Peptide
RKKKFLKIPKFKHLAKKF

SEQ ID NO: 3132 - protein, 18 aa, Artificial
  Short Peptide
FKKKFLKIPKFKHLAKKF

SEQ ID NO: 3133 - protein, 18 aa, Artificial
  Short Peptide
KWKKFLKIPKFKHLAKKF

SEQ ID NO: 3134 - protein, 18 aa, Artificial
  Short Peptide
RWKKFLKIPKFKHLAKKF

SEQ ID NO: 3135 - protein, 18 aa, Artificial
  Short Peptide
FWKKFLKIPKFKHLAKKF

SEQ ID NO: 3136 - protein, 18 aa, Artificial
  Short Peptide
KKKLLLKIPKFKHLAKKF

SEQ ID NO: 3137 - protein, 18 aa, Artificial
  Short Peptide
RKKLLLKIPKFKHLAKKF

SEQ ID NO: 3138 - protein, 18 aa, Artificial
  Short Peptide
FKKLLLKIPKFKHLAKKF

SEQ ID NO: 3139 - protein, 18 aa, Artificial
  Short Peptide
KWKLLLKIPKFKHLAKKF

SEQ ID NO: 3140 - protein, 18 aa, Artificial
  Short Peptide
RWKLLLKIPKFKHLAKKF

SEQ ID NO: 3141 - protein, 18 aa, Artificial
  Short Peptide
FWKLLLKIPKFKHLAKKF

SEQ ID NO: 3142 - protein, 18 aa, Artificial
  Short Peptide
KKKKLLKIPKFKHLAKKF

SEQ ID NO: 3143 - protein, 18 aa, Artificial
  Short Peptide
RKKKLLKIPKFKHLAKKF

SEQ ID NO: 3144 - protein, 18 aa, Artificial
  Short Peptide
FKKKLLKIPKFKHLAKKF

SEQ ID NO: 3145 - protein, 18 aa, Artificial
  Short Peptide
KWKKLLKIPKFKHLAKKF

SEQ ID NO: 3146 - protein, 18 aa, Artificial
  Short Peptide
RWKKLLKIPKFKHLAKKF

SEQ ID NO: 3147 - protein, 18 aa, Artificial
  Short Peptide
FWKKLLKIPKFKHLAKKF

SEQ ID NO: 3148 - protein, 18 aa, Artificial
  Short Peptide
KKKLFKKIPKFKHLAKKF

SEQ ID NO: 3149 - protein, 18 aa, Artificial
  Short Peptide
RKKLFKKIPKFKHLAKKF

SEQ ID NO: 3150 - protein, 18 aa, Artificial
  Short Peptide
FKKLFKKIPKFKHLAKKF

SEQ ID NO: 3151 - protein, 18 aa, Artificial
  Short Peptide
KWKLFKKIPKFKHLAKKF

SEQ ID NO: 3152 - protein, 18 aa, Artificial
  Short Peptide
RWKLFKKIPKFKHLAKKF

SEQ ID NO: 3153 - protein, 18 aa, Artificial
  Short Peptide
FWKLFKKIPKFKHLAKKF

SEQ ID NO: 3154 - protein, 18 aa, Artificial
  Short Peptide
KKKKFKKIPKFKHLAKKF

SEQ ID NO: 3155 - protein, 18 aa, Artificial
  Short Peptide
RKKKFKKIPKFKHLAKKF

SEQ ID NO: 3156 - protein, 18 aa, Artificial
  Short Peptide
FKKKFKKIPKFKHLAKKF

SEQ ID NO: 3157 - protein, 18 aa, Artificial
  Short Peptide
KWKKFKKIPKFKHLAKKF

SEQ ID NO: 3158 - protein, 18 aa, Artificial
  Short Peptide
RWKKFKKIPKFKHLAKKF

SEQ ID NO: 3159 - protein, 18 aa, Artificial
  Short Peptide
FWKKFKKIPKFKHLAKKF

SEQ ID NO: 3160 - protein, 18 aa, Artificial
  Short Peptide
KKKLLKKIPKFKHLAKKF

SEQ ID NO: 3161 - protein, 18 aa, Artificial
  Short Peptide
RKKLLKKIPKFKHLAKKF

SEQ ID NO: 3162 - protein, 18 aa, Artificial
  Short Peptide
FKKLLKKIPKFKHLAKKF

SEQ ID NO: 3163 - protein, 18 aa, Artificial
  Short Peptide
KWKLLKKIPKFKHLAKKF

SEQ ID NO: 3164 - protein, 18 aa, Artificial
  Short Peptide
RWKLLKKIPKFKHLAKKF

SEQ ID NO: 3165 - protein, 18 aa, Artificial
  Short Peptide
FWKLLKKIPKFKHLAKKF

SEQ ID NO: 3166 - protein, 18 aa, Artificial
  Short Peptide
KKKKLKKIPKFKHLAKKF

SEQ ID NO: 3167 - protein, 18 aa, Artificial
  Short Peptide
RKKKLKKIPKFKHLAKKF

SEQ ID NO: 3168 - protein, 18 aa, Artificial
  Short Peptide
FKKKLKKIPKFKHLAKKF

SEQ ID NO: 3169 - protein, 18 aa, Artificial
  Short Peptide
KWKKLKKIPKFKHLAKKF

SEQ ID NO: 3170 - protein, 18 aa, Artificial
  Short Peptide
RWKKLKKIPKFKHLAKKF

SEQ ID NO: 3171 - protein, 18 aa, Artificial
  Short Peptide
FWKKLKKIPKFKHLAKKF

SEQ ID NO: 3172 - protein, 20 aa, Artificial
  Short Peptide
KKKLFLKIPPPKFLKLAKKF

SEQ ID NO: 3173 - protein, 20 aa, Artificial
  Short Peptide
RKKLFLKIPPPKFLKLAKKF

SEQ ID NO: 3174 - protein, 20 aa, Artificial
  Short Peptide
FKKLFLKIPPPKFLKLAKKF

SEQ ID NO: 3175 - protein, 20 aa, Artificial
  Short Peptide
KWKLFLKIPPPKFLKLAKKF

SEQ ID NO: 3176 - protein, 20 aa, Artificial
  Short Peptide
RWKLFLKIPPPKFLKLAKKF

SEQ ID NO: 3177 - protein, 20 aa, Artificial
  Short Peptide
FWKLFLKIPPPKFLKLAKKF

SEQ ID NO: 3178 - protein, 20 aa, Artificial
  Short Peptide
KKKKFLKIPPPKFLKLAKKF

SEQ ID NO: 3179 - protein, 20 aa, Artificial
  Short Peptide
RKKKFLKIPPPKFLKLAKKF

SEQ ID NO: 3180 - protein, 20 aa, Artificial
  Short Peptide
FKKKFLKIPPPKFLKLAKKF

SEQ ID NO: 3181 - protein, 20 aa, Artificial
  Short Peptide
KWKKFLKIPPPKFLKLAKKF

SEQ ID NO: 3182 - protein, 20 aa, Artificial
  Short Peptide
RWKKFLKIPPPKFLKLAKKF

SEQ ID NO: 3183 - protein, 20 aa, Artificial
  Short Peptide
FWKKFLKIPPPKFLKLAKKF

SEQ ID NO: 3184 - protein, 20 aa, Artificial
  Short Peptide
KKKLLLKIPPPKFLKLAKKF

SEQ ID NO: 3185 - protein, 20 aa, Artificial
  Short Peptide
RKKLLLKIPPPKFLKLAKKF

SEQ ID NO: 3186 - protein, 20 aa, Artificial
  Short Peptide
FKKLLLKIPPPKFLKLAKKF

SEQ ID NO: 3187 - protein, 20 aa, Artificial
  Short Peptide
KWKLLLKIPPPKFLKLAKKF

SEQ ID NO: 3188 - protein, 20 aa, Artificial
  Short Peptide
RWKLLLKIPPPKFLKLAKKF

SEQ ID NO: 3189 - protein, 20 aa, Artificial
  Short Peptide
FWKLLLKIPPPKFLKLAKKF

SEQ ID NO: 3190 - protein, 20 aa, Artificial
  Short Peptide
KKKKLLKIPPPKFLKLAKKF

SEQ ID NO: 3191 - protein, 20 aa, Artificial
  Short Peptide
RKKKLLKIPPPKFLKLAKKF

SEQ ID NO: 3192 - protein, 20 aa, Artificial
  Short Peptide
FKKKLLKIPPPKFLKLAKKF

SEQ ID NO: 3193 - protein, 20 aa, Artificial
  Short Peptide
KWKKLLKIPPPKFLKLAKKF

SEQ ID NO: 3194 - protein, 20 aa, Artificial
  Short Peptide
RWKKLLKIPPPKFLKLAKKF

SEQ ID NO: 3195 - protein, 20 aa, Artificial
  Short Peptide
FWKKLLKIPPPKFLKLAKKF

SEQ ID NO: 3196 - protein, 20 aa, Artificial
  Short Peptide
KKKLFKKIPPPKFLKLAKKF

SEQ ID NO: 3197 - protein, 20 aa, Artificial
  Short Peptide
RKKLFKKIPPPKFLKLAKKF

SEQ ID NO: 3198 - protein, 20 aa, Artificial
  Short Peptide
FKKLFKKIPPPKFLKLAKKF

SEQ ID NO: 3199 - protein, 20 aa, Artificial
  Short Peptide
KWKLFKKIPPPKFLKLAKKF

SEQ ID NO: 3200 - protein, 20 aa, Artificial
  Short Peptide
RWKLFKKIPPPKFLKLAKKF

SEQ ID NO: 3201 - protein, 20 aa, Artificial
  Short Peptide
FWKLFKKIPPPKFLKLAKKF

SEQ ID NO: 3202 - protein, 20 aa, Artificial
  Short Peptide
KKKKFKKIPPPKFLKLAKKF

SEQ ID NO: 3203 - protein, 20 aa, Artificial
  Short Peptide
RKKKFKKIPPPKFLKLAKKF

SEQ ID NO: 3204 - protein, 20 aa, Artificial
  Short Peptide
FKKKFKKIPPPKFLKLAKKF

SEQ ID NO: 3205 - protein, 20 aa, Artificial
  Short Peptide
KWKKFKKIPPPKFLKLAKKF

SEQ ID NO: 3206 - protein, 20 aa, Artificial
  Short Peptide
RWKKFKKIPPPKFLKLAKKF

SEQ ID NO: 3207 - protein, 20 aa, Artificial
  Short Peptide
FWKKFKKIPPPKFLKLAKKF

SEQ ID NO: 3208 - protein, 20 aa, Artificial
  Short Peptide
KKKLLKKIPPPKFLKLAKKF

SEQ ID NO: 3209 - protein, 20 aa, Artificial
  Short Peptide
RKKLLKKIPPPKFLKLAKKF

SEQ ID NO: 3210 - protein, 20 aa, Artificial
  Short Peptide
FKKLLKKIPPPKFLKLAKKF

SEQ ID NO: 3211 - protein, 20 aa, Artificial
  Short Peptide
KWKLLKKIPPPKFLKLAKKF

SEQ ID NO: 3212 - protein, 20 aa, Artificial
  Short Peptide
RWKLLKKIPPPKFLKLAKKF

SEQ ID NO: 3213 - protein, 20 aa, Artificial
  Short Peptide
FWKLLKKIPPPKFLKLAKKF

SEQ ID NO: 3214 - protein, 20 aa, Artificial
  Short Peptide
KKKKLKKIPPPKFLKLAKKF

SEQ ID NO: 3215 - protein, 20 aa, Artificial
  Short Peptide
RKKKLKKIPPPKFLKLAKKF

SEQ ID NO: 3216 - protein, 20 aa, Artificial
  Short Peptide
FKKKLKKIPPPKFLKLAKKF

SEQ ID NO: 3217 - protein, 20 aa, Artificial
  Short Peptide
KWKKLKKIPPPKFLKLAKKF

SEQ ID NO: 3218 - protein, 20 aa, Artificial
  Short Peptide
RWKKLKKIPPPKFLKLAKKF

SEQ ID NO: 3219 - protein, 20 aa, Artificial
  Short Peptide
FWKKLKKIPPPKFLKLAKKF

SEQ ID NO: 3220 - protein, 19 aa, Artificial
  Short Peptide
KKKLFLKIPPKFLKLAKKF

SEQ ID NO: 3221 - protein, 19 aa, Artificial
  Short Peptide
RKKLFLKIPPKFLKLAKKF

SEQ ID NO: 3222 - protein, 19 aa, Artificial
  Short Peptide
FKKLFLKIPPKFLKLAKKF

SEQ ID NO: 3223 - protein, 19 aa, Artificial
  Short Peptide
KWKLFLKIPPKFLKLAKKF

SEQ ID NO: 3224 - protein, 19 aa, Artificial
  Short Peptide
RWKLFLKIPPKFLKLAKKF

SEQ ID NO: 3225 - protein, 19 aa, Artificial
  Short Peptide
FWKLFLKIPPKFLKLAKKF

SEQ ID NO: 3226 - protein, 19 aa, Artificial
  Short Peptide
KKKKFLKIPPKFLKLAKKF

SEQ ID NO: 3227 - protein, 19 aa, Artificial
  Short Peptide
RKKKFLKIPPKFLKLAKKF

SEQ ID NO: 3228 - protein, 19 aa, Artificial
  Short Peptide
FKKKFLKIPPKFLKLAKKF

SEQ ID NO: 3229 - protein, 19 aa, Artificial
  Short Peptide
KWKKFLKIPPKFLKLAKKF

SEQ ID NO: 3230 - protein, 19 aa, Artificial
  Short Peptide
RWKKFLKIPPKFLKLAKKF

SEQ ID NO: 3231 - protein, 19 aa, Artificial
  Short Peptide
FWKKFLKIPPKFLKLAKKF

SEQ ID NO: 3232 - protein, 19 aa, Artificial
  Short Peptide
KKKLLLKIPPKFLKLAKKF

SEQ ID NO: 3233 - protein, 19 aa, Artificial
  Short Peptide
RKKLLLKIPPKFLKLAKKF

SEQ ID NO: 3234 - protein, 19 aa, Artificial
  Short Peptide
FKKLLLKIPPKFLKLAKKF

SEQ ID NO: 3235 - protein, 19 aa, Artificial
  Short Peptide
KWKLLLKIPPKFLKLAKKF

SEQ ID NO: 3236 - protein, 19 aa, Artificial
  Short Peptide
RWKLLLKIPPKFLKLAKKF

SEQ ID NO: 3237 - protein, 19 aa, Artificial
  Short Peptide
FWKLLLKIPPKFLKLAKKF

SEQ ID NO: 3238 - protein, 19 aa, Artificial
  Short Peptide
KKKKLLKIPPKFLKLAKKF

SEQ ID NO: 3239 - protein, 19 aa, Artificial
  Short Peptide
RKKKLLKIPPKFLKLAKKF

SEQ ID NO: 3240 - protein, 19 aa, Artificial
  Short Peptide
FKKKLLKIPPKFLKLAKKF

SEQ ID NO: 3241 - protein, 19 aa, Artificial
  Short Peptide
KWKKLLKIPPKFLKLAKKF

SEQ ID NO: 3242 - protein, 19 aa, Artificial
  Short Peptide
RWKKLLKIPPKFLKLAKKF

SEQ ID NO: 3243 - protein, 19 aa, Artificial
  Short Peptide
FWKKLLKIPPKFLKLAKKF

SEQ ID NO: 3244 - protein, 19 aa, Artificial
  Short Peptide
KKKLFKKIPPKFLKLAKKF

SEQ ID NO: 3245 - protein, 19 aa, Artificial
  Short Peptide
RKKLFKKIPPKFLKLAKKF

SEQ ID NO: 3246 - protein, 19 aa, Artificial
  Short Peptide
FKKLFKKIPPKFLKLAKKF

SEQ ID NO: 3247 - protein, 19 aa, Artificial
  Short Peptide
KWKLFKKIPPKFLKLAKKF

SEQ ID NO: 3248 - protein, 19 aa, Artificial
  Short Peptide
RWKLFKKIPPKFLKLAKKF

SEQ ID NO: 3249 - protein, 19 aa, Artificial
  Short Peptide
FWKLFKKIPPKFLKLAKKF

SEQ ID NO: 3250 - protein, 19 aa, Artificial
  Short Peptide
KKKKFKKIPPKFLKLAKKF

SEQ ID NO: 3251 - protein, 19 aa, Artificial
  Short Peptide
RKKKFKKIPPKFLKLAKKF

SEQ ID NO: 3252 - protein, 19 aa, Artificial
  Short Peptide
FKKKFKKIPPKFLKLAKKF

SEQ ID NO: 3253 - protein, 19 aa, Artificial
  Short Peptide
KWKKFKKIPPKFLKLAKKF

SEQ ID NO: 3254 - protein, 19 aa, Artificial
  Short Peptide
RWKKFKKIPPKFLKLAKKF

SEQ ID NO: 3255 - protein, 19 aa, Artificial
  Short Peptide
FWKKFKKIPPKFLKLAKKF

SEQ ID NO: 3256 - protein, 19 aa, Artificial
  Short Peptide
KKKLLKKIPPKFLKLAKKF

SEQ ID NO: 3257 - protein, 19 aa, Artificial
  Short Peptide
RKKLLKKIPPKFLKLAKKF

SEQ ID NO: 3258 - protein, 19 aa, Artificial
  Short Peptide
FKKLLKKIPPKFLKLAKKF

SEQ ID NO: 3259 - protein, 19 aa, Artificial
  Short Peptide
KWKLLKKIPPKFLKLAKKF

SEQ ID NO: 3260 - protein, 19 aa, Artificial
  Short Peptide
RWKLLKKIPPKFLKLAKKF

SEQ ID NO: 3261 - protein, 19 aa, Artificial
  Short Peptide
FWKLLKKIPPKFLKLAKKF

SEQ ID NO: 3262 - protein, 19 aa, Artificial
  Short Peptide
KKKKLKKIPPKFLKLAKKF

SEQ ID NO: 3263 - protein, 19 aa, Artificial
  Short Peptide
RKKKLKKIPPKFLKLAKKF

SEQ ID NO: 3264 - protein, 19 aa, Artificial
  Short Peptide
FKKKLKKIPPKFLKLAKKF

SEQ ID NO: 3265 - protein, 19 aa, Artificial
  Short Peptide
KWKKLKKIPPKFLKLAKKF

SEQ ID NO: 3266 - protein, 19 aa, Artificial
  Short Peptide
RWKKLKKIPPKFLKLAKKF

SEQ ID NO: 3267 - protein, 19 aa, Artificial
  Short Peptide
FWKKLKKIPPKFLKLAKKF

SEQ ID NO: 3268 - protein, 18 aa, Artificial
  Short Peptide
KKKLFLKIPKFLKLAKKF

SEQ ID NO: 3269 - protein, 18 aa, Artificial
  Short Peptide
RKKLFLKIPKFLKLAKKF

SEQ ID NO: 3270 - protein, 18 aa, Artificial
  Short Peptide
FKKLFLKIPKFLKLAKKF

SEQ ID NO: 3271 - protein, 18 aa, Artificial
  Short Peptide
KWKLFLKIPKFLKLAKKF

SEQ ID NO: 3272 - protein, 18 aa, Artificial
  Short Peptide
RWKLFLKIPKFLKLAKKF

SEQ ID NO: 3273 - protein, 18 aa, Artificial
  Short Peptide
FWKLFLKIPKFLKLAKKF

SEQ ID NO: 3274 - protein, 18 aa, Artificial
  Short Peptide
KKKKFLKIPKFLKLAKKF

SEQ ID NO: 3275 - protein, 18 aa, Artificial
  Short Peptide
RKKKFLKIPKFLKLAKKF

SEQ ID NO: 3276 - protein, 18 aa, Artificial
  Short Peptide
FKKKFLKIPKFLKLAKKF

SEQ ID NO: 3277 - protein, 18 aa, Artificial
  Short Peptide
KWKKFLKIPKFLKLAKKF

SEQ ID NO: 3278 - protein, 18 aa, Artificial
  Short Peptide
RWKKFLKIPKFLKLAKKF

SEQ ID NO: 3279 - protein, 18 aa, Artificial
  Short Peptide
FWKKFLKIPKFLKLAKKF

SEQ ID NO: 3280 - protein, 18 aa, Artificial
  Short Peptide
KKKLLLKIPKFLKLAKKF

SEQ ID NO: 3281 - protein, 18 aa, Artificial
  Short Peptide
RKKLLLKIPKFLKLAKKF

SEQ ID NO: 3282 - protein, 18 aa, Artificial
  Short Peptide
FKKLLLKIPKFLKLAKKF

SEQ ID NO: 3283 - protein, 18 aa, Artificial
  Short Peptide
KWKLLLKIPKFLKLAKKF

SEQ ID NO: 3284 - protein, 18 aa, Artificial
  Short Peptide
RWKLLLKIPKFLKLAKKF

SEQ ID NO: 3285 - protein, 18 aa, Artificial
  Short Peptide
FWKLLLKIPKFLKLAKKF

SEQ ID NO: 3286 - protein, 18 aa, Artificial
  Short Peptide
KKKKLLKIPKFLKLAKKF

SEQ ID NO: 3287 - protein, 18 aa, Artificial
  Short Peptide
RKKKLLKIPKFLKLAKKF

SEQ ID NO: 3288 - protein, 18 aa, Artificial
  Short Peptide
FKKKLLKIPKFLKLAKKF

SEQ ID NO: 3289 - protein, 18 aa, Artificial
  Short Peptide
KWKKLLKIPKFLKLAKKF

SEQ ID NO: 3290 - protein, 18 aa, Artificial
  Short Peptide
RWKKLLKIPKFLKLAKKF

SEQ ID NO: 3291 - protein, 18 aa, Artificial
  Short Peptide
FWKKLLKIPKFLKLAKKF

SEQ ID NO: 3292 - protein, 18 aa, Artificial
  Short Peptide
KKKLFKKIPKFLKLAKKF

SEQ ID NO: 3293 - protein, 18 aa, Artificial
  Short Peptide
RKKLFKKIPKFLKLAKKF

SEQ ID NO: 3294 - protein, 18 aa, Artificial
  Short Peptide
FKKLFKKIPKFLKLAKKF

SEQ ID NO: 3295 - protein, 18 aa, Artificial
  Short Peptide
KWKLFKKIPKFLKLAKKF

SEQ ID NO: 3296 - protein, 18 aa, Artificial
  Short Peptide
RWKLFKKIPKFLKLAKKF

SEQ ID NO: 3297 - protein, 18 aa, Artificial
  Short Peptide
FWKLFKKIPKFLKLAKKF

SEQ ID NO: 3298 - protein, 18 aa, Artificial
  Short Peptide
KKKKFKKIPKFLKLAKKF

SEQ ID NO: 3299 - protein, 18 aa, Artificial
  Short Peptide
RKKKFKKIPKFLKLAKKF

SEQ ID NO: 3300 - protein, 18 aa, Artificial
  Short Peptide
FKKKFKKIPKFLKLAKKF

SEQ ID NO: 3301 - protein, 18 aa, Artificial
  Short Peptide
KWKKFKKIPKFLKLAKKF

SEQ ID NO: 3302 - protein, 18 aa, Artificial
  Short Peptide
RWKKFKKIPKFLKLAKKF

SEQ ID NO: 3303 - protein, 18 aa, Artificial
  Short Peptide
FWKKFKKIPKFLKLAKKF

SEQ ID NO: 3304 - protein, 18 aa, Artificial
  Short Peptide
KKKLLKKIPKFLKLAKKF

SEQ ID NO: 3305 - protein, 18 aa, Artificial
  Short Peptide
RKKLLKKIPKFLKLAKKF

SEQ ID NO: 3306 - protein, 18 aa, Artificial
  Short Peptide
FKKLLKKIPKFLKLAKKF

SEQ ID NO: 3307 - protein, 18 aa, Artificial
  Short Peptide
KWKLLKKIPKFLKLAKKF

SEQ ID NO: 3308 - protein, 18 aa, Artificial
  Short Peptide
RWKLLKKIPKFLKLAKKF

SEQ ID NO: 3309 - protein, 18 aa, Artificial
  Short Peptide
FWKLLKKIPKFLKLAKKF

SEQ ID NO: 3310 - protein, 18 aa, Artificial
  Short Peptide
KKKKLKKIPKFLKLAKKF

SEQ ID NO: 3311 - protein, 18 aa, Artificial
  Short Peptide
RKKKLKKIPKFLKLAKKF

SEQ ID NO: 3312 - protein, 18 aa, Artificial
  Short Peptide
FKKKLKKIPKFLKLAKKF

SEQ ID NO: 3313 - protein, 18 aa, Artificial
  Short Peptide
KWKKLKKIPKFLKLAKKF

SEQ ID NO: 3314 - protein, 18 aa, Artificial
  Short Peptide
RWKKLKKIPKFLKLAKKF

SEQ ID NO: 3315 - protein, 18 aa, Artificial
  Short Peptide
FWKKLKKIPKFLKLAKKF

SEQ ID NO: 3316 - protein, 20 aa, Artificial
  Short Peptide
KKKLFLKIPPPKFKKLAKKF

SEQ ID NO: 3317 - protein, 20 aa, Artificial
  Short Peptide
RKKLFLKIPPPKFKKLAKKF

SEQ ID NO: 3318 - protein, 20 aa, Artificial
  Short Peptide
FKKLFLKIPPPKFKKLAKKF

SEQ ID NO: 3319 - protein, 20 aa, Artificial
  Short Peptide
KWKLFLKIPPPKFKKLAKKF

SEQ ID NO: 3320 - protein, 20 aa, Artificial
  Short Peptide
RWKLFLKIPPPKFKKLAKKF

SEQ ID NO: 3321 - protein, 20 aa, Artificial
  Short Peptide
FWKLFLKIPPPKFKKLAKKF

SEQ ID NO: 3322 - protein, 20 aa, Artificial
  Short Peptide
KKKKFLKIPPPKFKKLAKKF

SEQ ID NO: 3323 - protein, 20 aa, Artificial
  Short Peptide
RKKKFLKIPPPKFKKLAKKF

SEQ ID NO: 3324 - protein, 20 aa, Artificial
  Short Peptide
FKKKFLKIPPPKFKKLAKKF

SEQ ID NO: 3325 - protein, 20 aa, Artificial
  Short Peptide
KWKKFLKIPPPKFKKLAKKF

SEQ ID NO: 3326 - protein, 20 aa, Artificial
  Short Peptide
RWKKFLKIPPPKFKKLAKKF

SEQ ID NO: 3327 - protein, 20 aa, Artificial
  Short Peptide
FWKKFLKIPPPKFKKLAKKF

SEQ ID NO: 3328 - protein, 20 aa, Artificial
  Short Peptide
KKKLLLKIPPPKFKKLAKKF

SEQ ID NO: 3329 - protein, 20 aa, Artificial
  Short Peptide
RKKLLLKIPPPKFKKLAKKF

SEQ ID NO: 3330 - protein, 20 aa, Artificial
  Short Peptide
FKKLLLKIPPPKFKKLAKKF

SEQ ID NO: 3331 - protein, 20 aa, Artificial
  Short Peptide
KWKLLLKIPPPKFKKLAKKF

SEQ ID NO: 3332 - protein, 20 aa, Artificial
  Short Peptide
RWKLLLKIPPPKFKKLAKKF

SEQ ID NO: 3333 - protein, 20 aa, Artificial
  Short Peptide
FWKLLLKIPPPKFKKLAKKF

SEQ ID NO: 3334 - protein, 20 aa, Artificial
  Short Peptide
KKKKLLKIPPPKFKKLAKKF

SEQ ID NO: 3335 - protein, 20 aa, Artificial
  Short Peptide
RKKKLLKIPPPKFKKLAKKF

SEQ ID NO: 3336 - protein, 20 aa, Artificial
  Short Peptide
FKKKLLKIPPPKFKKLAKKF

SEQ ID NO: 3337 - protein, 20 aa, Artificial
  Short Peptide
KWKKLLKIPPPKFKKLAKKF

SEQ ID NO: 3338 - protein, 20 aa, Artificial
  Short Peptide
RWKKLLKIPPPKFKKLAKKF

SEQ ID NO: 3339 - protein, 20 aa, Artificial
  Short Peptide
FWKKLLKIPPPKFKKLAKKF

SEQ ID NO: 3340 - protein, 20 aa, Artificial
  Short Peptide
KKKLFKKIPPPKFKKLAKKF

SEQ ID NO: 3341 - protein, 20 aa, Artificial
  Short Peptide
RKKLFKKIPPPKFKKLAKKF

SEQ ID NO: 3342 - protein, 20 aa, Artificial
  Short Peptide
FKKLFKKIPPPKFKKLAKKF

SEQ ID NO: 3343 - protein, 20 aa, Artificial
  Short Peptide
KWKLFKKIPPPKFKKLAKKF

SEQ ID NO: 3344 - protein, 20 aa, Artificial
  Short Peptide
RWKLFKKIPPPKFKKLAKKF

SEQ ID NO: 3345 - protein, 20 aa, Artificial
  Short Peptide
FWKLFKKIPPPKFKKLAKKF

SEQ ID NO: 3346 - protein, 20 aa, Artificial
  Short Peptide
KKKKFKKIPPPKFKKLAKKF

SEQ ID NO: 3347 - protein, 20 aa, Artificial
  Short Peptide
RKKKFKKIPPPKFKKLAKKF

SEQ ID NO: 3348 - protein, 20 aa, Artificial
  Short Peptide
FKKKFKKIPPPKFKKLAKKF

SEQ ID NO: 3349 - protein, 20 aa, Artificial
  Short Peptide
KWKKFKKIPPPKFKKLAKKF

SEQ ID NO: 3350 - protein, 20 aa, Artificial
  Short Peptide
RWKKFKKIPPPKFKKLAKKF

SEQ ID NO: 3351 - protein, 20 aa, Artificial
  Short Peptide
FWKKFKKIPPPKFKKLAKKF

SEQ ID NO: 3352 - protein, 20 aa, Artificial
  Short Peptide
KKKLLKKIPPPKFKKLAKKF

SEQ ID NO: 3353 - protein, 20 aa, Artificial
  Short Peptide
RKKLLKKIPPPKFKKLAKKF

SEQ ID NO: 3354 - protein, 20 aa, Artificial
  Short Peptide
FKKLLKKIPPPKFKKLAKKF

SEQ ID NO: 3355 - protein, 20 aa, Artificial
  Short Peptide
KWKLLKKIPPPKFKKLAKKF

SEQ ID NO: 3356 - protein, 20 aa, Artificial
  Short Peptide
RWKLLKKIPPPKFKKLAKKF

SEQ ID NO: 3357 - protein, 20 aa, Artificial
  Short Peptide
FWKLLKKIPPPKFKKLAKKF

SEQ ID NO: 3358 - protein, 20 aa, Artificial
  Short Peptide
KKKKLKKIPPPKFKKLAKKF

SEQ ID NO: 3359 - protein, 20 aa, Artificial
  Short Peptide
RKKKLKKIPPPKFKKLAKKF

SEQ ID NO: 3360 - protein, 20 aa, Artificial
  Short Peptide
FKKKLKKIPPPKFKKLAKKF

SEQ ID NO: 3361 - protein, 20 aa, Artificial
  Short Peptide
KWKKLKKIPPPKFKKLAKKF

SEQ ID NO: 3362 - protein, 20 aa, Artificial
  Short Peptide
RWKKLKKIPPPKFKKLAKKF

SEQ ID NO: 3363 - protein, 20 aa, Artificial
  Short Peptide
FWKKLKKIPPPKFKKLAKKF

SEQ ID NO: 3364 - protein, 19 aa, Artificial
  Short Peptide
KKKLFLKIPPKFKKLAKKF

SEQ ID NO: 3365 - protein, 19 aa, Artificial
  Short Peptide
RKKLFLKIPPKFKKLAKKF

SEQ ID NO: 3366 - protein, 19 aa, Artificial
  Short Peptide
FKKLFLKIPPKFKKLAKKF

SEQ ID NO: 3367 - protein, 19 aa, Artificial
  Short Peptide
KWKLFLKIPPKFKKLAKKF

SEQ ID NO: 3368 - protein, 19 aa, Artificial
  Short Peptide
RWKLFLKIPPKFKKLAKKF

SEQ ID NO: 3369 - protein, 19 aa, Artificial
  Short Peptide
FWKLFLKIPPKFKKLAKKF

SEQ ID NO: 3370 - protein, 19 aa, Artificial
  Short Peptide
KKKKFLKIPPKFKKLAKKF

SEQ ID NO: 3371 - protein, 19 aa, Artificial
  Short Peptide
RKKKFLKIPPKFKKLAKKF

SEQ ID NO: 3372 - protein, 19 aa, Artificial
  Short Peptide
FKKKFLKIPPKFKKLAKKF

SEQ ID NO: 3373 - protein, 19 aa, Artificial
  Short Peptide
KWKKFLKIPPKFKKLAKKF

SEQ ID NO: 3374 - protein, 19 aa, Artificial
  Short Peptide
RWKKFLKIPPKFKKLAKKF

SEQ ID NO: 3375 - protein, 19 aa, Artificial
  Short Peptide
FWKKFLKIPPKFKKLAKKF

SEQ ID NO: 3376 - protein, 19 aa, Artificial
  Short Peptide
KKKLLLKIPPKFKKLAKKF

SEQ ID NO: 3377 - protein, 19 aa, Artificial
  Short Peptide
RKKLLLKIPPKFKKLAKKF

SEQ ID NO: 3378 - protein, 19 aa, Artificial
  Short Peptide
FKKLLLKIPPKFKKLAKKF

SEQ ID NO: 3379 - protein, 19 aa, Artificial
  Short Peptide
KWKLLLKIPPKFKKLAKKF

SEQ ID NO: 3380 - protein, 19 aa, Artificial
  Short Peptide
RWKLLLKIPPKFKKLAKKF

SEQ ID NO: 3381 - protein, 19 aa, Artificial
  Short Peptide
FWKLLLKIPPKFKKLAKKF

SEQ ID NO: 3382 - protein, 19 aa, Artificial
  Short Peptide
KKKKLLKIPPKFKKLAKKF

SEQ ID NO: 3383 - protein, 19 aa, Artificial
  Short Peptide
RKKKLLKIPPKFKKLAKKF

SEQ ID NO: 3384 - protein, 19 aa, Artificial
  Short Peptide
FKKKLLKIPPKFKKLAKKF

SEQ ID NO: 3385 - protein, 19 aa, Artificial
  Short Peptide
KWKKLLKIPPKFKKLAKKF

SEQ ID NO: 3386 - protein, 19 aa, Artificial
  Short Peptide
RWKKLLKIPPKFKKLAKKF

SEQ ID NO: 3387 - protein, 19 aa, Artificial
  Short Peptide
FWKKLLKIPPKFKKLAKKF

SEQ ID NO: 3388 - protein, 19 aa, Artificial
  Short Peptide
KKKLFKKIPPKFKKLAKKF

SEQ ID NO: 3389 - protein, 19 aa, Artificial
  Short Peptide
RKKLFKKIPPKFKKLAKKF

SEQ ID NO: 3390 - protein, 19 aa, Artificial
  Short Peptide
FKKLFKKIPPKFKKLAKKF

SEQ ID NO: 3391 - protein, 19 aa, Artificial
  Short Peptide
KWKLFKKIPPKFKKLAKKF

SEQ ID NO: 3392 - protein, 19 aa, Artificial
  Short Peptide
RWKLFKKIPPKFKKLAKKF

SEQ ID NO: 3393 - protein, 19 aa, Artificial
  Short Peptide
FWKLFKKIPPKFKKLAKKF

SEQ ID NO: 3394 - protein, 19 aa, Artificial
  Short Peptide
KKKKFKKIPPKFKKLAKKF

SEQ ID NO: 3395 - protein, 19 aa, Artificial
  Short Peptide
RKKKFKKIPPKFKKLAKKF

SEQ ID NO: 3396 - protein, 19 aa, Artificial
  Short Peptide
FKKKFKKIPPKFKKLAKKF

SEQ ID NO: 3397 - protein, 19 aa, Artificial
  Short Peptide
KWKKFKKIPPKFKKLAKKF

SEQ ID NO: 3398 - protein, 19 aa, Artificial
  Short Peptide
RWKKFKKIPPKFKKLAKKF

SEQ ID NO: 3399 - protein, 19 aa, Artificial
  Short Peptide
FWKKFKKIPPKFKKLAKKF

SEQ ID NO: 3400 - protein, 19 aa, Artificial
  Short Peptide
KKKLLKKIPPKFKKLAKKF

SEQ ID NO: 3401 - protein, 19 aa, Artificial
  Short Peptide
RKKLLKKIPPKFKKLAKKF

SEQ ID NO: 3402 - protein, 19 aa, Artificial
  Short Peptide
FKKLLKKIPPKFKKLAKKF

SEQ ID NO: 3403 - protein, 19 aa, Artificial
  Short Peptide
KWKLLKKIPPKFKKLAKKF

SEQ ID NO: 3404 - protein, 19 aa, Artificial
  Short Peptide
RWKLLKKIPPKFKKLAKKF

SEQ ID NO: 3405 - protein, 19 aa, Artificial
  Short Peptide
FWKLLKKIPPKFKKLAKKF

SEQ ID NO: 3406 - protein, 19 aa, Artificial
  Short Peptide
KKKKLKKIPPKFKKLAKKF

SEQ ID NO: 3407 - protein, 19 aa, Artificial
  Short Peptide
RKKKLKKIPPKFKKLAKKF

SEQ ID NO: 3408 - protein, 19 aa, Artificial
  Short Peptide
FKKKLKKIPPKFKKLAKKF

SEQ ID NO: 3409 - protein, 19 aa, Artificial
  Short Peptide
KWKKLKKIPPKFKKLAKKF

SEQ ID NO: 3410 - protein, 19 aa, Artificial
  Short Peptide
RWKKLKKIPPKFKKLAKKF

SEQ ID NO: 3411 - protein, 19 aa, Artificial
  Short Peptide
FWKKLKKIPPKFKKLAKKF

SEQ ID NO: 3412 - protein, 18 aa, Artificial
  Short Peptide
KKKLFLKIPKFKKLAKKF

SEQ ID NO: 3413 - protein, 18 aa, Artificial
  Short Peptide
RKKLFLKIPKFKKLAKKF

SEQ ID NO: 3414 - protein, 18 aa, Artificial
  Short Peptide
FKKLFLKIPKFKKLAKKF

SEQ ID NO: 3415 - protein, 18 aa, Artificial
  Short Peptide
KWKLFLKIPKFKKLAKKF

SEQ ID NO: 3416 - protein, 18 aa, Artificial
  Short Peptide
RWKLFLKIPKFKKLAKKF

SEQ ID NO: 3417 - protein, 18 aa, Artificial
  Short Peptide
FWKLFLKIPKFKKLAKKF

SEQ ID NO: 3418 - protein, 18 aa, Artificial
  Short Peptide
KKKKFLKIPKFKKLAKKF

SEQ ID NO: 3419 - protein, 18 aa, Artificial
  Short Peptide
RKKKFLKIPKFKKLAKKF

SEQ ID NO: 3420 - protein, 18 aa, Artificial
  Short Peptide
FKKKFLKIPKFKKLAKKF

SEQ ID NO: 3421 - protein, 18 aa, Artificial
  Short Peptide
KWKKFLKIPKFKKLAKKF

SEQ ID NO: 3422 - protein, 18 aa, Artificial
  Short Peptide
RWKKFLKIPKFKKLAKKF

SEQ ID NO: 3423 - protein, 18 aa, Artificial
  Short Peptide
FWKKFLKIPKFKKLAKKF

SEQ ID NO: 3424 - protein, 18 aa, Artificial
  Short Peptide
KKKLLLKIPKFKKLAKKF

SEQ ID NO: 3425 - protein, 18 aa, Artificial
  Short Peptide
RKKLLLKIPKFKKLAKKF

SEQ ID NO: 3426 - protein, 18 aa, Artificial
  Short Peptide
FKKLLLKIPKFKKLAKKF

SEQ ID NO: 3427 - protein, 18 aa, Artificial
  Short Peptide
KWKLLLKIPKFKKLAKKF

SEQ ID NO: 3428 - protein, 18 aa, Artificial
  Short Peptide
RWKLLLKIPKFKKLAKKF

SEQ ID NO: 3429 - protein, 18 aa, Artificial
  Short Peptide
FWKLLLKIPKFKKLAKKF

SEQ ID NO: 3430 - protein, 18 aa, Artificial
  Short Peptide
KKKKLLKIPKFKKLAKKF

SEQ ID NO: 3431 - protein, 18 aa, Artificial
  Short Peptide
RKKKLLKIPKFKKLAKKF

SEQ ID NO: 3432 - protein, 18 aa, Artificial
  Short Peptide
FKKKLLKIPKFKKLAKKF

SEQ ID NO: 3433 - protein, 18 aa, Artificial
  Short Peptide
KWKKLLKIPKFKKLAKKF

SEQ ID NO: 3434 - protein, 18 aa, Artificial
  Short Peptide
RWKKLLKIPKFKKLAKKF

SEQ ID NO: 3435 - protein, 18 aa, Artificial
  Short Peptide
FWKKLLKIPKFKKLAKKF

SEQ ID NO: 3436 - protein, 18 aa, Artificial
  Short Peptide
KKKLFKKIPKFKKLAKKF

SEQ ID NO: 3437 - protein, 18 aa, Artificial
  Short Peptide
RKKLFKKIPKFKKLAKKF

SEQ ID NO: 3438 - protein, 18 aa, Artificial
  Short Peptide
FKKLFKKIPKFKKLAKKF

SEQ ID NO: 3439 - protein, 18 aa, Artificial
  Short Peptide
KWKLFKKIPKFKKLAKKF

SEQ ID NO: 3440 - protein, 18 aa, Artificial
  Short Peptide
RWKLFKKIPKFKKLAKKF

SEQ ID NO: 3441 - protein, 18 aa, Artificial
  Short Peptide
FWKLFKKIPKFKKLAKKF

SEQ ID NO: 3442 - protein, 18 aa, Artificial
  Short Peptide
KKKKFKKIPKFKKLAKKF

SEQ ID NO: 3443 - protein, 18 aa, Artificial
  Short Peptide
RKKKFKKIPKFKKLAKKF

SEQ ID NO: 3444 - protein, 18 aa, Artificial
  Short Peptide
FKKKFKKIPKFKKLAKKF

SEQ ID NO: 3445 - protein, 18 aa, Artificial
  Short Peptide
KWKKFKKIPKFKKLAKKF

SEQ ID NO: 3446 - protein, 18 aa, Artificial
  Short Peptide
RWKKFKKIPKFKKLAKKF

SEQ ID NO: 3447 - protein, 18 aa, Artificial
  Short Peptide
FWKKFKKIPKFKKLAKKF

SEQ ID NO: 3448 - protein, 18 aa, Artificial
  Short Peptide
KKKLLKKIPKFKKLAKKF

SEQ ID NO: 3449 - protein, 18 aa, Artificial
  Short Peptide
RKKLLKKIPKFKKLAKKF

SEQ ID NO: 3450 - protein, 18 aa, Artificial
  Short Peptide
FKKLLKKIPKFKKLAKKF

SEQ ID NO: 3451 - protein, 18 aa, Artificial
  Short Peptide
KWKLLKKIPKFKKLAKKF

SEQ ID NO: 3452 - protein, 18 aa, Artificial
  Short Peptide
RWKLLKKIPKFKKLAKKF

SEQ ID NO: 3453 - protein, 18 aa, Artificial
  Short Peptide
FWKLLKKIPKFKKLAKKF

SEQ ID NO: 3454 - protein, 18 aa, Artificial
  Short Peptide
KKKKLKKIPKFKKLAKKF

SEQ ID NO: 3455 - protein, 18 aa, Artificial
  Short Peptide
RKKKLKKIPKFKKLAKKF

SEQ ID NO: 3456 - protein, 18 aa, Artificial
  Short Peptide
FKKKLKKIPKFKKLAKKF

SEQ ID NO: 3457 - protein, 18 aa, Artificial
  Short Peptide
KWKKLKKIPKFKKLAKKF

SEQ ID NO: 3458 - protein, 18 aa, Artificial
  Short Peptide
RWKKLKKIPKFKKLAKKF

SEQ ID NO: 3459 - protein, 18 aa, Artificial
  Short Peptide
FWKKLKKIPKFKKLAKKF

SEQ ID NO: 3460 - protein, 20 aa, Artificial
  Short Peptide
KKKLFLKIPPPKFLHVAKKF

SEQ ID NO: 3461 - protein, 20 aa, Artificial
  Short Peptide
RKKLFLKIPPPKFLHVAKKF

SEQ ID NO: 3462 - protein, 20 aa, Artificial
  Short Peptide
FKKLFLKIPPPKFLHVAKKF

SEQ ID NO: 3463 - protein, 20 aa, Artificial
  Short Peptide
KWKLFLKIPPPKFLHVAKKF

SEQ ID NO: 3464 - protein, 20 aa, Artificial
  Short Peptide
RWKLFLKIPPPKFLHVAKKF

SEQ ID NO: 3465 - protein, 20 aa, Artificial
  Short Peptide
FWKLFLKIPPPKFLHVAKKF

SEQ ID NO: 3466 - protein, 20 aa, Artificial
  Short Peptide
KKKKFLKIPPPKFLHVAKKF

SEQ ID NO: 3467 - protein, 20 aa, Artificial
  Short Peptide
RKKKFLKIPPPKFLHVAKKF

SEQ ID NO: 3468 - protein, 20 aa, Artificial
  Short Peptide
FKKKFLKIPPPKFLHVAKKF

SEQ ID NO: 3469 - protein, 20 aa, Artificial
  Short Peptide
KWKKFLKIPPPKFLHVAKKF

SEQ ID NO: 3470 - protein, 20 aa, Artificial
  Short Peptide
RWKKFLKIPPPKFLHVAKKF

SEQ ID NO: 3471 - protein, 20 aa, Artificial
  Short Peptide
FWKKFLKIPPPKFLHVAKKF

SEQ ID NO: 3472 - protein, 20 aa, Artificial
  Short Peptide
KKKLLLKIPPPKFLHVAKKF

SEQ ID NO: 3473 - protein, 20 aa, Artificial
  Short Peptide
RKKLLLKIPPPKFLHVAKKF

SEQ ID NO: 3474 - protein, 20 aa, Artificial
  Short Peptide
FKKLLLKIPPPKFLHVAKKF

SEQ ID NO: 3475 - protein, 20 aa, Artificial
  Short Peptide
KWKLLLKIPPPKFLHVAKKF

SEQ ID NO: 3476 - protein, 20 aa, Artificial
  Short Peptide
RWKLLLKIPPPKFLHVAKKF

SEQ ID NO: 3477 - protein, 20 aa, Artificial
  Short Peptide
FWKLLLKIPPPKFLHVAKKF

SEQ ID NO: 3478 - protein, 20 aa, Artificial
  Short Peptide
KKKKLLKIPPPKFLHVAKKF

SEQ ID NO: 3479 - protein, 20 aa, Artificial
  Short Peptide
RKKKLLKIPPPKFLHVAKKF

SEQ ID NO: 3480 - protein, 20 aa, Artificial
  Short Peptide
FKKKLLKIPPPKFLHVAKKF

SEQ ID NO: 3481 - protein, 20 aa, Artificial
  Short Peptide
KWKKLLKIPPPKFLHVAKKF

SEQ ID NO: 3482 - protein, 20 aa, Artificial
  Short Peptide
RWKKLLKIPPPKFLHVAKKF

SEQ ID NO: 3483 - protein, 20 aa, Artificial
  Short Peptide
FWKKLLKIPPPKFLHVAKKF

SEQ ID NO: 3484 - protein, 20 aa, Artificial
  Short Peptide
KKKLFKKIPPPKFLHVAKKF

SEQ ID NO: 3485 - protein, 20 aa, Artificial
  Short Peptide
RKKLFKKIPPPKFLHVAKKF

SEQ ID NO: 3486 - protein, 20 aa, Artificial
  Short Peptide
FKKLFKKIPPPKFLHVAKKF

SEQ ID NO: 3487 - protein, 20 aa, Artificial
  Short Peptide
KWKLFKKIPPPKFLHVAKKF

SEQ ID NO: 3488 - protein, 20 aa, Artificial
  Short Peptide
RWKLFKKIPPPKFLHVAKKF

SEQ ID NO: 3489 - protein, 20 aa, Artificial
  Short Peptide
FWKLFKKIPPPKFLHVAKKF

SEQ ID NO: 3490 - protein, 20 aa, Artificial
  Short Peptide
KKKKFKKIPPPKFLHVAKKF

SEQ ID NO: 3491 - protein, 20 aa, Artificial
  Short Peptide
RKKKFKKIPPPKFLHVAKKF

SEQ ID NO: 3492 - protein, 20 aa, Artificial
  Short Peptide
FKKKFKKIPPPKFLHVAKKF

SEQ ID NO: 3493 - protein, 20 aa, Artificial
  Short Peptide
KWKKFKKIPPPKFLHVAKKF

SEQ ID NO: 3494 - protein, 20 aa, Artificial
  Short Peptide
RWKKFKKIPPPKFLHVAKKF

SEQ ID NO: 3495 - protein, 20 aa, Artificial
  Short Peptide
FWKKFKKIPPPKFLHVAKKF

SEQ ID NO: 3496 - protein, 20 aa, Artificial
  Short Peptide
KKKLLKKIPPPKFLHVAKKF

SEQ ID NO: 3497 - protein, 20 aa, Artificial
  Short Peptide
RKKLLKKIPPPKFLHVAKKF

SEQ ID NO: 3498 - protein, 20 aa, Artificial
  Short Peptide
FKKLLKKIPPPKFLHVAKKF

SEQ ID NO: 3499 - protein, 20 aa, Artificial
  Short Peptide
KWKLLKKIPPPKFLHVAKKF

SEQ ID NO: 3500 - protein, 20 aa, Artificial
  Short Peptide
RWKLLKKIPPPKFLHVAKKF

SEQ ID NO: 3501 - protein, 20 aa, Artificial
  Short Peptide
FWKLLKKIPPPKFLHVAKKF

SEQ ID NO: 3502 - protein, 20 aa, Artificial
  Short Peptide
KKKKLKKIPPPKFLHVAKKF

SEQ ID NO: 3503 - protein, 20 aa, Artificial
  Short Peptide
RKKKLKKIPPPKFLHVAKKF

SEQ ID NO: 3504 - protein, 20 aa, Artificial
  Short Peptide
FKKKLKKIPPPKFLHVAKKF

SEQ ID NO: 3505 - protein, 20 aa, Artificial
  Short Peptide
KWKKLKKIPPPKFLHVAKKF

SEQ ID NO: 3506 - protein, 20 aa, Artificial
  Short Peptide
RWKKLKKIPPPKFLHVAKKF

SEQ ID NO: 3507 - protein, 20 aa, Artificial
  Short Peptide
FWKKLKKIPPPKFLHVAKKF

SEQ ID NO: 3508 - protein, 19 aa, Artificial
  Short Peptide
KKKLFLKIPPKFLHVAKKF

SEQ ID NO: 3509 - protein, 19 aa, Artificial
  Short Peptide
RKKLFLKIPPKFLHVAKKF

SEQ ID NO: 3510 - protein, 19 aa, Artificial
  Short Peptide
FKKLFLKIPPKFLHVAKKF

SEQ ID NO: 3511 - protein, 19 aa, Artificial
  Short Peptide
KWKLFLKIPPKFLHVAKKF

SEQ ID NO: 3512 - protein, 19 aa, Artificial
  Short Peptide
RWKLFLKIPPKFLHVAKKF

SEQ ID NO: 3513 - protein, 19 aa, Artificial
  Short Peptide
FWKLFLKIPPKFLHVAKKF

SEQ ID NO: 3514 - protein, 19 aa, Artificial
  Short Peptide
KKKKFLKIPPKFLHVAKKF

SEQ ID NO: 3515 - protein, 19 aa, Artificial
  Short Peptide
RKKKFLKIPPKFLHVAKKF

SEQ ID NO: 3516 - protein, 19 aa, Artificial
  Short Peptide
FKKKFLKIPPKFLHVAKKF

SEQ ID NO: 3517 - protein, 19 aa, Artificial
  Short Peptide
KWKKFLKIPPKFLHVAKKF

SEQ ID NO: 3518 - protein, 19 aa, Artificial
  Short Peptide
RWKKFLKIPPKFLHVAKKF

SEQ ID NO: 3519 - protein, 19 aa, Artificial
  Short Peptide
FWKKFLKIPPKFLHVAKKF

SEQ ID NO: 3520 - protein, 19 aa, Artificial
  Short Peptide
KKKLLLKIPPKFLHVAKKF

SEQ ID NO: 3521 - protein, 19 aa, Artificial
  Short Peptide
RKKLLLKIPPKFLHVAKKF

SEQ ID NO: 3522 - protein, 19 aa, Artificial
  Short Peptide
FKKLLLKIPPKFLHVAKKF

SEQ ID NO: 3523 - protein, 19 aa, Artificial
  Short Peptide
KWKLLLKIPPKFLHVAKKF

SEQ ID NO: 3524 - protein, 19 aa, Artificial
  Short Peptide
RWKLLLKIPPKFLHVAKKF

SEQ ID NO: 3525 - protein, 19 aa, Artificial
  Short Peptide
FWKLLLKIPPKFLHVAKKF

SEQ ID NO: 3526 - protein, 19 aa, Artificial
  Short Peptide
KKKKLLKIPPKFLHVAKKF

SEQ ID NO: 3527 - protein, 19 aa, Artificial
  Short Peptide
RKKKLLKIPPKFLHVAKKF

SEQ ID NO: 3528 - protein, 19 aa, Artificial
  Short Peptide
FKKKLLKIPPKFLHVAKKF

SEQ ID NO: 3529 - protein, 19 aa, Artificial
  Short Peptide
KWKKLLKIPPKFLHVAKKF

SEQ ID NO: 3530 - protein, 19 aa, Artificial
  Short Peptide
RWKKLLKIPPKFLHVAKKF

SEQ ID NO: 3531 - protein, 19 aa, Artificial
  Short Peptide
FWKKLLKIPPKFLHVAKKF

SEQ ID NO: 3532 - protein, 19 aa, Artificial
  Short Peptide
KKKLFKKIPPKFLHVAKKF

SEQ ID NO: 3533 - protein, 19 aa, Artificial
  Short Peptide
RKKLFKKIPPKFLHVAKKF

SEQ ID NO: 3534 - protein, 19 aa, Artificial
  Short Peptide
FKKLFKKIPPKFLHVAKKF

SEQ ID NO: 3535 - protein, 19 aa, Artificial
  Short Peptide
KWKLFKKIPPKFLHVAKKF

SEQ ID NO: 3536 - protein, 19 aa, Artificial
  Short Peptide
RWKLFKKIPPKFLHVAKKF

SEQ ID NO: 3537 - protein, 19 aa, Artificial
  Short Peptide
FWKLFKKIPPKFLHVAKKF

SEQ ID NO: 3538 - protein, 19 aa, Artificial
  Short Peptide
KKKKFKKIPPKFLHVAKKF

SEQ ID NO: 3539 - protein, 19 aa, Artificial
  Short Peptide
RKKKFKKIPPKFLHVAKKF

SEQ ID NO: 3540 - protein, 19 aa, Artificial
  Short Peptide
FKKKFKKIPPKFLHVAKKF

SEQ ID NO: 3541 - protein, 19 aa, Artificial
  Short Peptide
KWKKFKKIPPKFLHVAKKF

SEQ ID NO: 3542 - protein, 19 aa, Artificial
  Short Peptide
RWKKFKKIPPKFLHVAKKF

SEQ ID NO: 3543 - protein, 19 aa, Artificial
  Short Peptide
FWKKFKKIPPKFLHVAKKF

SEQ ID NO: 3544 - protein, 19 aa, Artificial
  Short Peptide
KKKLLKKIPPKFLHVAKKF

SEQ ID NO: 3545 - protein, 19 aa, Artificial
  Short Peptide
RKKLLKKIPPKFLHVAKKF

SEQ ID NO: 3546 - protein, 19 aa, Artificial
  Short Peptide
FKKLLKKIPPKFLHVAKKF

SEQ ID NO: 3547 - protein, 19 aa, Artificial
  Short Peptide
KWKLLKKIPPKFLHVAKKF

SEQ ID NO: 3548 - protein, 19 aa, Artificial
  Short Peptide
RWKLLKKIPPKFLHVAKKF

SEQ ID NO: 3549 - protein, 19 aa, Artificial
  Short Peptide
FWKLLKKIPPKFLHVAKKF

SEQ ID NO: 3550 - protein, 19 aa, Artificial
  Short Peptide
KKKKLKKIPPKFLHVAKKF

SEQ ID NO: 3551 - protein, 19 aa, Artificial
  Short Peptide
RKKKLKKIPPKFLHVAKKF

SEQ ID NO: 3552 - protein, 19 aa, Artificial
  Short Peptide
FKKKLKKIPPKFLHVAKKF

SEQ ID NO: 3553 - protein, 19 aa, Artificial
  Short Peptide
KWKKLKKIPPKFLHVAKKF

SEQ ID NO: 3554 - protein, 19 aa, Artificial
  Short Peptide
RWKKLKKIPPKFLHVAKKF

SEQ ID NO: 3555 - protein, 19 aa, Artificial
  Short Peptide
FWKKLKKIPPKFLHVAKKF

SEQ ID NO: 3556 - protein, 18 aa, Artificial
  Short Peptide
KKKLFLKIPKFLHVAKKF

SEQ ID NO: 3557 - protein, 18 aa, Artificial
  Short Peptide
RKKLFLKIPKFLHVAKKF

SEQ ID NO: 3558 - protein, 18 aa, Artificial
  Short Peptide
FKKLFLKIPKFLHVAKKF

SEQ ID NO: 3559 - protein, 18 aa, Artificial
  Short Peptide
KWKLFLKIPKFLHVAKKF

SEQ ID NO: 3560 - protein, 18 aa, Artificial
  Short Peptide
RWKLFLKIPKFLHVAKKF

SEQ ID NO: 3561 - protein, 18 aa, Artificial
  Short Peptide
FWKLFLKIPKFLHVAKKF

SEQ ID NO: 3562 - protein, 18 aa, Artificial
  Short Peptide
KKKKFLKIPKFLHVAKKF

SEQ ID NO: 3563 - protein, 18 aa, Artificial
  Short Peptide
RKKKFLKIPKFLHVAKKF

SEQ ID NO: 3564 - protein, 18 aa, Artificial
  Short Peptide
FKKKFLKIPKFLHVAKKF

SEQ ID NO: 3565 - protein, 18 aa, Artificial
  Short Peptide
KWKKFLKIPKFLHVAKKF

SEQ ID NO: 3566 - protein, 18 aa, Artificial
  Short Peptide
RWKKFLKIPKFLHVAKKF

SEQ ID NO: 3567 - protein, 18 aa, Artificial
  Short Peptide
FWKKFLKIPKFLHVAKKF

SEQ ID NO: 3568 - protein, 18 aa, Artificial
  Short Peptide
KKKLLLKIPKFLHVAKKF

SEQ ID NO: 3569 - protein, 18 aa, Artificial
  Short Peptide
RKKLLLKIPKFLHVAKKF

SEQ ID NO: 3570 - protein, 18 aa, Artificial
  Short Peptide
FKKLLLKIPKFLHVAKKF

SEQ ID NO: 3571 - protein, 18 aa, Artificial
  Short Peptide
KWKLLLKIPKFLHVAKKF

SEQ ID NO: 3572 - protein, 18 aa, Artificial
  Short Peptide
RWKLLLKIPKFLHVAKKF

SEQ ID NO: 3573 - protein, 18 aa, Artificial
  Short Peptide
FWKLLLKIPKFLHVAKKF

SEQ ID NO: 3574 - protein, 18 aa, Artificial
  Short Peptide
KKKKLLKIPKFLHVAKKF

SEQ ID NO: 3575 - protein, 18 aa, Artificial
  Short Peptide
RKKKLLKIPKFLHVAKKF

SEQ ID NO: 3576 - protein, 18 aa, Artificial
  Short Peptide
FKKKLLKIPKFLHVAKKF

SEQ ID NO: 3577 - protein, 18 aa, Artificial
  Short Peptide
KWKKLLKIPKFLHVAKKF

SEQ ID NO: 3578 - protein, 18 aa, Artificial
  Short Peptide
RWKKLLKIPKFLHVAKKF

SEQ ID NO: 3579 - protein, 18 aa, Artificial
  Short Peptide
FWKKLLKIPKFLHVAKKF

SEQ ID NO: 3580 - protein, 18 aa, Artificial
  Short Peptide
KKKLFKKIPKFLHVAKKF

SEQ ID NO: 3581 - protein, 18 aa, Artificial
  Short Peptide
RKKLFKKIPKFLHVAKKF

SEQ ID NO: 3582 - protein, 18 aa, Artificial
  Short Peptide
FKKLFKKIPKFLHVAKKF

SEQ ID NO: 3583 - protein, 18 aa, Artificial
  Short Peptide
KWKLFKKIPKFLHVAKKF

SEQ ID NO: 3584 - protein, 18 aa, Artificial
  Short Peptide
RWKLFKKIPKFLHVAKKF

SEQ ID NO: 3585 - protein, 18 aa, Artificial
  Short Peptide
FWKLFKKIPKFLHVAKKF

SEQ ID NO: 3586 - protein, 18 aa, Artificial
  Short Peptide
KKKKFKKIPKFLHVAKKF

SEQ ID NO: 3587 - protein, 18 aa, Artificial
  Short Peptide
RKKKFKKIPKFLHVAKKF

SEQ ID NO: 3588 - protein, 18 aa, Artificial
  Short Peptide
FKKKFKKIPKFLHVAKKF

SEQ ID NO: 3589 - protein, 18 aa, Artificial
  Short Peptide
KWKKFKKIPKFLHVAKKF

SEQ ID NO: 3590 - protein, 18 aa, Artificial
  Short Peptide
RWKKFKKIPKFLHVAKKF

SEQ ID NO: 3591 - protein, 18 aa, Artificial
  Short Peptide
FWKKFKKIPKFLHVAKKF

SEQ ID NO: 3592 - protein, 18 aa, Artificial
  Short Peptide
KKKLLKKIPKFLHVAKKF

SEQ ID NO: 3593 - protein, 18 aa, Artificial
  Short Peptide
RKKLLKKIPKFLHVAKKF

SEQ ID NO: 3594 - protein, 18 aa, Artificial
  Short Peptide
FKKLLKKIPKFLHVAKKF

SEQ ID NO: 3595 - protein, 18 aa, Artificial
  Short Peptide
KWKLLKKIPKFLHVAKKF

SEQ ID NO: 3596 - protein, 18 aa, Artificial
  Short Peptide
RWKLLKKIPKFLHVAKKF

SEQ ID NO: 3597 - protein, 18 aa, Artificial
  Short Peptide
FWKLLKKIPKFLHVAKKF

SEQ ID NO: 3598 - protein, 18 aa, Artificial
  Short Peptide
KKKKLKKIPKFLHVAKKF

SEQ ID NO: 3599 - protein, 18 aa, Artificial
  Short Peptide
RKKKLKKIPKFLHVAKKF

SEQ ID NO: 3600 - protein, 18 aa, Artificial
  Short Peptide
FKKKLKKIPKFLHVAKKF

SEQ ID NO: 3601 - protein, 18 aa, Artificial
  Short Peptide
KWKKLKKIPKFLHVAKKF

SEQ ID NO: 3602 - protein, 18 aa, Artificial
  Short Peptide
RWKKLKKIPKFLHVAKKF

SEQ ID NO: 3603 - protein, 18 aa, Artificial
  Short Peptide
FWKKLKKIPKFLHVAKKF

SEQ ID NO: 3604 - protein, 20 aa, Artificial
  Short Peptide
KKKLFLKIPPPKFKHVAKKF

SEQ ID NO: 3605 - protein, 20 aa, Artificial
  Short Peptide
RKKLFLKIPPPKFKHVAKKF

SEQ ID NO: 3606 - protein, 20 aa, Artificial
  Short Peptide
FKKLFLKIPPPKFKHVAKKF

SEQ ID NO: 3607 - protein, 20 aa, Artificial
  Short Peptide
KWKLFLKIPPPKFKHVAKKF

SEQ ID NO: 3608 - protein, 20 aa, Artificial
  Short Peptide
RWKLFLKIPPPKFKHVAKKF

SEQ ID NO: 3609 - protein, 20 aa, Artificial
  Short Peptide
FWKLFLKIPPPKFKHVAKKF

SEQ ID NO: 3610 - protein, 20 aa, Artificial
  Short Peptide
KKKKFLKIPPPKFKHVAKKF

SEQ ID NO: 3611 - protein, 20 aa, Artificial
  Short Peptide
RKKKFLKIPPPKFKHVAKKF

SEQ ID NO: 3612 - protein, 20 aa, Artificial
  Short Peptide
FKKKFLKIPPPKFKHVAKKF

SEQ ID NO: 3613 - protein, 20 aa, Artificial
  Short Peptide
KWKKFLKIPPPKFKHVAKKF

SEQ ID NO: 3614 - protein, 20 aa, Artificial
  Short Peptide
RWKKFLKIPPPKFKHVAKKF

SEQ ID NO: 3615 - protein, 20 aa, Artificial
  Short Peptide
FWKKFLKIPPPKFKHVAKKF

SEQ ID NO: 3616 - protein, 20 aa, Artificial
  Short Peptide
KKKLLLKIPPPKFKHVAKKF

SEQ ID NO: 3617 - protein, 20 aa, Artificial
  Short Peptide
RKKLLLKIPPPKFKHVAKKF

SEQ ID NO: 3618 - protein, 20 aa, Artificial
  Short Peptide
FKKLLLKIPPPKFKHVAKKF

SEQ ID NO: 3619 - protein, 20 aa, Artificial
  Short Peptide
KWKLLLKIPPPKFKHVAKKF

SEQ ID NO: 3620 - protein, 20 aa, Artificial
  Short Peptide
RWKLLLKIPPPKFKHVAKKF

SEQ ID NO: 3621 - protein, 20 aa, Artificial
  Short Peptide
FWKLLLKIPPPKFKHVAKKF

SEQ ID NO: 3622 - protein, 20 aa, Artificial
  Short Peptide
KKKKLLKIPPPKFKHVAKKF

SEQ ID NO: 3623 - protein, 20 aa, Artificial
  Short Peptide
RKKKLLKIPPPKFKHVAKKF

SEQ ID NO: 3624 - protein, 20 aa, Artificial
  Short Peptide
FKKKLLKIPPPKFKHVAKKF

SEQ ID NO: 3625 - protein, 20 aa, Artificial
  Short Peptide
KWKKLLKIPPPKFKHVAKKF

SEQ ID NO: 3626 - protein, 20 aa, Artificial
  Short Peptide
RWKKLLKIPPPKFKHVAKKF

SEQ ID NO: 3627 - protein, 20 aa, Artificial
  Short Peptide
FWKKLLKIPPPKFKHVAKKF

SEQ ID NO: 3628 - protein, 20 aa, Artificial
  Short Peptide
KKKLFKKIPPPKFKHVAKKF

SEQ ID NO: 3629 - protein, 20 aa, Artificial
  Short Peptide
RKKLFKKIPPPKFKHVAKKF

SEQ ID NO: 3630 - protein, 20 aa, Artificial
  Short Peptide
FKKLFKKIPPPKFKHVAKKF

SEQ ID NO: 3631 - protein, 20 aa, Artificial
  Short Peptide
KWKLFKKIPPPKFKHVAKKF

SEQ ID NO: 3632 - protein, 20 aa, Artificial
  Short Peptide
RWKLFKKIPPPKFKHVAKKF

SEQ ID NO: 3633 - protein, 20 aa, Artificial
  Short Peptide
FWKLFKKIPPPKFKHVAKKF

SEQ ID NO: 3634 - protein, 20 aa, Artificial
  Short Peptide
KKKKFKKIPPPKFKHVAKKF

SEQ ID NO: 3635 - protein, 20 aa, Artificial
  Short Peptide
RKKKFKKIPPPKFKHVAKKF

SEQ ID NO: 3636 - protein, 20 aa, Artificial
  Short Peptide
FKKKFKKIPPPKFKHVAKKF

SEQ ID NO: 3637 - protein, 20 aa, Artificial
  Short Peptide
KWKKFKKIPPPKFKHVAKKF

SEQ ID NO: 3638 - protein, 20 aa, Artificial
  Short Peptide
RWKKFKKIPPPKFKHVAKKF

SEQ ID NO: 3639 - protein, 20 aa, Artificial
  Short Peptide
FWKKFKKIPPPKFKHVAKKF

SEQ ID NO: 3640 - protein, 20 aa, Artificial
  Short Peptide
KKKLLKKIPPPKFKHVAKKF

SEQ ID NO: 3641 - protein, 20 aa, Artificial
  Short Peptide
RKKLLKKIPPPKFKHVAKKF

SEQ ID NO: 3642 - protein, 20 aa, Artificial
  Short Peptide
FKKLLKKIPPPKFKHVAKKF

SEQ ID NO: 3643 - protein, 20 aa, Artificial
  Short Peptide
KWKLLKKIPPPKFKHVAKKF

SEQ ID NO: 3644 - protein, 20 aa, Artificial
  Short Peptide
RWKLLKKIPPPKFKHVAKKF

SEQ ID NO: 3645 - protein, 20 aa, Artificial
  Short Peptide
FWKLLKKIPPPKFKHVAKKF

SEQ ID NO: 3646 - protein, 20 aa, Artificial
  Short Peptide
KKKKLKKIPPPKFKHVAKKF

SEQ ID NO: 3647 - protein, 20 aa, Artificial
  Short Peptide
RKKKLKKIPPPKFKHVAKKF

SEQ ID NO: 3648 - protein, 20 aa, Artificial
  Short Peptide
FKKKLKKIPPPKFKHVAKKF

SEQ ID NO: 3649 - protein, 20 aa, Artificial
  Short Peptide
KWKKLKKIPPPKFKHVAKKF

SEQ ID NO: 3650 - protein, 20 aa, Artificial
  Short Peptide
RWKKLKKIPPPKFKHVAKKF

SEQ ID NO: 3651 - protein, 20 aa, Artificial
  Short Peptide
FWKKLKKIPPPKFKHVAKKF

SEQ ID NO: 3652 - protein, 19 aa, Artificial
  Short Peptide
KKKLFLKIPPKFKHVAKKF

SEQ ID NO: 3653 - protein, 19 aa, Artificial
  Short Peptide
RKKLFLKIPPKFKHVAKKF

SEQ ID NO: 3654 - protein, 19 aa, Artificial
  Short Peptide
FKKLFLKIPPKFKHVAKKF

SEQ ID NO: 3655 - protein, 19 aa, Artificial
  Short Peptide
KWKLFLKIPPKFKHVAKKF

SEQ ID NO: 3656 - protein, 19 aa, Artificial
  Short Peptide
RWKLFLKIPPKFKHVAKKF

SEQ ID NO: 3657 - protein, 19 aa, Artificial
  Short Peptide
FWKLFLKIPPKFKHVAKKF

SEQ ID NO: 3658 - protein, 19 aa, Artificial
  Short Peptide
KKKKFLKIPPKFKHVAKKF

SEQ ID NO: 3659 - protein, 19 aa, Artificial
  Short Peptide
RKKKFLKIPPKFKHVAKKF

SEQ ID NO: 3660 - protein, 19 aa, Artificial
  Short Peptide
FKKKFLKIPPKFKHVAKKF

SEQ ID NO: 3661 - protein, 19 aa, Artificial
  Short Peptide
KWKKFLKIPPKFKHVAKKF

SEQ ID NO: 3662 - protein, 19 aa, Artificial
  Short Peptide
RWKKFLKIPPKFKHVAKKF

SEQ ID NO: 3663 - protein, 19 aa, Artificial
  Short Peptide
FWKKFLKIPPKFKHVAKKF

SEQ ID NO: 3664 - protein, 19 aa, Artificial
  Short Peptide
KKKLLLKIPPKFKHVAKKF

SEQ ID NO: 3665 - protein, 19 aa, Artificial
  Short Peptide
RKKLLLKIPPKFKHVAKKF

SEQ ID NO: 3666 - protein, 19 aa, Artificial
  Short Peptide
FKKLLLKIPPKFKHVAKKF

SEQ ID NO: 3667 - protein, 19 aa, Artificial
  Short Peptide
KWKLLLKIPPKFKHVAKKF

SEQ ID NO: 3668 - protein, 19 aa, Artificial
  Short Peptide
RWKLLLKIPPKFKHVAKKF

SEQ ID NO: 3669 - protein, 19 aa, Artificial
  Short Peptide
FWKLLLKIPPKFKHVAKKF

SEQ ID NO: 3670 - protein, 19 aa, Artificial
  Short Peptide
KKKKLLKIPPKFKHVAKKF

SEQ ID NO: 3671 - protein, 19 aa, Artificial
  Short Peptide
RKKKLLKIPPKFKHVAKKF

SEQ ID NO: 3672 - protein, 19 aa, Artificial
  Short Peptide
FKKKLLKIPPKFKHVAKKF

SEQ ID NO: 3673 - protein, 19 aa, Artificial
  Short Peptide
KWKKLLKIPPKFKHVAKKF

SEQ ID NO: 3674 - protein, 19 aa, Artificial
  Short Peptide
RWKKLLKIPPKFKHVAKKF

SEQ ID NO: 3675 - protein, 19 aa, Artificial
  Short Peptide
FWKKLLKIPPKFKHVAKKF

SEQ ID NO: 3676 - protein, 19 aa, Artificial
  Short Peptide
KKKLFKKIPPKFKHVAKKF

SEQ ID NO: 3677 - protein, 19 aa, Artificial
  Short Peptide
RKKLFKKIPPKFKHVAKKF

SEQ ID NO: 3678 - protein, 19 aa, Artificial
  Short Peptide
FKKLFKKIPPKFKHVAKKF

SEQ ID NO: 3679 - protein, 19 aa, Artificial
  Short Peptide
KWKLFKKIPPKFKHVAKKF

SEQ ID NO: 3680 - protein, 19 aa, Artificial
  Short Peptide
RWKLFKKIPPKFKHVAKKF

SEQ ID NO: 3681 - protein, 19 aa, Artificial
  Short Peptide
FWKLFKKIPPKFKHVAKKF

SEQ ID NO: 3682 - protein, 19 aa, Artificial
  Short Peptide
KKKKFKKIPPKFKHVAKKF

SEQ ID NO: 3683 - protein, 19 aa, Artificial
  Short Peptide
RKKKFKKIPPKFKHVAKKF

SEQ ID NO: 3684 - protein, 19 aa, Artificial
  Short Peptide
FKKKFKKIPPKFKHVAKKF

SEQ ID NO: 3685 - protein, 19 aa, Artificial
  Short Peptide
KWKKFKKIPPKFKHVAKKF

SEQ ID NO: 3686 - protein, 19 aa, Artificial
  Short Peptide
RWKKFKKIPPKFKHVAKKF

SEQ ID NO: 3687 - protein, 19 aa, Artificial
  Short Peptide
FWKKFKKIPPKFKHVAKKF

SEQ ID NO: 3688 - protein, 19 aa, Artificial
  Short Peptide
KKKLLKKIPPKFKHVAKKF

SEQ ID NO: 3689 - protein, 19 aa, Artificial
  Short Peptide
RKKLLKKIPPKFKHVAKKF

SEQ ID NO: 3690 - protein, 19 aa, Artificial
  Short Peptide
FKKLLKKIPPKFKHVAKKF

SEQ ID NO: 3691 - protein, 19 aa, Artificial
  Short Peptide
KWKLLKKIPPKFKHVAKKF

SEQ ID NO: 3692 - protein, 19 aa, Artificial
  Short Peptide
RWKLLKKIPPKFKHVAKKF

SEQ ID NO: 3693 - protein, 19 aa, Artificial
  Short Peptide
FWKLLKKIPPKFKHVAKKF

SEQ ID NO: 3694 - protein, 19 aa, Artificial
  Short Peptide
KKKKLKKIPPKFKHVAKKF

SEQ ID NO: 3695 - protein, 19 aa, Artificial
  Short Peptide
RKKKLKKIPPKFKHVAKKF

SEQ ID NO: 3696 - protein, 19 aa, Artificial
  Short Peptide
FKKKLKKIPPKFKHVAKKF

SEQ ID NO: 3697 - protein, 19 aa, Artificial
  Short Peptide
KWKKLKKIPPKFKHVAKKF

SEQ ID NO: 3698 - protein, 19 aa, Artificial
  Short Peptide
RWKKLKKIPPKFKHVAKKF

SEQ ID NO: 3699 - protein, 19 aa, Artificial
  Short Peptide
FWKKLKKIPPKFKHVAKKF

SEQ ID NO: 3700 - protein, 18 aa, Artificial
  Short Peptide
KKKLFLKIPKFKHVAKKF

SEQ ID NO: 3701 - protein, 18 aa, Artificial
  Short Peptide
RKKLFLKIPKFKHVAKKF

SEQ ID NO: 3702 - protein, 18 aa, Artificial
  Short Peptide
FKKLFLKIPKFKHVAKKF

SEQ ID NO: 3703 - protein, 18 aa, Artificial
  Short Peptide
KWKLFLKIPKFKHVAKKF

SEQ ID NO: 3704 - protein, 18 aa, Artificial
  Short Peptide
RWKLFLKIPKFKHVAKKF

SEQ ID NO: 3705 - protein, 18 aa, Artificial
  Short Peptide
FWKLFLKIPKFKHVAKKF

SEQ ID NO: 3706 - protein, 18 aa, Artificial
  Short Peptide
KKKKFLKIPKFKHVAKKF

SEQ ID NO: 3707 - protein, 18 aa, Artificial
  Short Peptide
RKKKFLKIPKFKHVAKKF

SEQ ID NO: 3708 - protein, 18 aa, Artificial
  Short Peptide
FKKKFLKIPKFKHVAKKF

SEQ ID NO: 3709 - protein, 18 aa, Artificial
  Short Peptide
KWKKFLKIPKFKHVAKKF

SEQ ID NO: 3710 - protein, 18 aa, Artificial
  Short Peptide
RWKKFLKIPKFKHVAKKF

SEQ ID NO: 3711 - protein, 18 aa, Artificial
  Short Peptide
FWKKFLKIPKFKHVAKKF

SEQ ID NO: 3712 - protein, 18 aa, Artificial
  Short Peptide
KKKLLLKIPKFKHVAKKF

SEQ ID NO: 3713 - protein, 18 aa, Artificial
  Short Peptide
RKKLLLKIPKFKHVAKKF

SEQ ID NO: 3714 - protein, 18 aa, Artificial
  Short Peptide
FKKLLLKIPKFKHVAKKF

SEQ ID NO: 3715 - protein, 18 aa, Artificial
  Short Peptide
KWKLLLKIPKFKHVAKKF

SEQ ID NO: 3716 - protein, 18 aa, Artificial
  Short Peptide
RWKLLLKIPKFKHVAKKF

SEQ ID NO: 3717 - protein, 18 aa, Artificial
  Short Peptide
FWKLLLKIPKFKHVAKKF

SEQ ID NO: 3718 - protein, 18 aa, Artificial
  Short Peptide
KKKKLLKIPKFKHVAKKF

SEQ ID NO: 3719 - protein, 18 aa, Artificial
  Short Peptide
RKKKLLKIPKFKHVAKKF

SEQ ID NO: 3720 - protein, 18 aa, Artificial
  Short Peptide
FKKKLLKIPKFKHVAKKF

SEQ ID NO: 3721 - protein, 18 aa, Artificial
  Short Peptide
KWKKLLKIPKFKHVAKKF

SEQ ID NO: 3722 - protein, 18 aa, Artificial
  Short Peptide
RWKKLLKIPKFKHVAKKF

SEQ ID NO: 3723 - protein, 18 aa, Artificial
  Short Peptide
FWKKLLKIPKFKHVAKKF

SEQ ID NO: 3724 - protein, 18 aa, Artificial
  Short Peptide
KKKLFKKIPKFKHVAKKF

SEQ ID NO: 3725 - protein, 18 aa, Artificial
  Short Peptide
RKKLFKKIPKFKHVAKKF

SEQ ID NO: 3726 - protein, 18 aa, Artificial
  Short Peptide
FKKLFKKIPKFKHVAKKF

SEQ ID NO: 3727 - protein, 18 aa, Artificial
  Short Peptide
KWKLFKKIPKFKHVAKKF

SEQ ID NO: 3728 - protein, 18 aa, Artificial
  Short Peptide
RWKLFKKIPKFKHVAKKF

SEQ ID NO: 3729 - protein, 18 aa, Artificial
  Short Peptide
FWKLFKKIPKFKHVAKKF

SEQ ID NO: 3730 - protein, 18 aa, Artificial
  Short Peptide
KKKKFKKIPKFKHVAKKF

SEQ ID NO: 3731 - protein, 18 aa, Artificial
  Short Peptide
RKKKFKKIPKFKHVAKKF

SEQ ID NO: 3732 - protein, 18 aa, Artificial
  Short Peptide
FKKKFKKIPKFKHVAKKF

SEQ ID NO: 3733 - protein, 18 aa, Artificial
  Short Peptide
KWKKFKKIPKFKHVAKKF

SEQ ID NO: 3734 - protein, 18 aa, Artificial
  Short Peptide
RWKKFKKIPKFKHVAKKF

SEQ ID NO: 3735 - protein, 18 aa, Artificial
  Short Peptide
FWKKFKKIPKFKHVAKKF

SEQ ID NO: 3736 - protein, 18 aa, Artificial
  Short Peptide
KKKLLKKIPKFKHVAKKF

SEQ ID NO: 3737 - protein, 18 aa, Artificial
  Short Peptide
RKKLLKKIPKFKHVAKKF

SEQ ID NO: 3738 - protein, 18 aa, Artificial
  Short Peptide
FKKLLKKIPKFKHVAKKF

SEQ ID NO: 3739 - protein, 18 aa, Artificial
  Short Peptide
KWKLLKKIPKFKHVAKKF

SEQ ID NO: 3740 - protein, 18 aa, Artificial
  Short Peptide
RWKLLKKIPKFKHVAKKF

SEQ ID NO: 3741 - protein, 18 aa, Artificial
  Short Peptide
FWKLLKKIPKFKHVAKKF

SEQ ID NO: 3742 - protein, 18 aa, Artificial
  Short Peptide
KKKKLKKIPKFKHVAKKF

SEQ ID NO: 3743 - protein, 18 aa, Artificial
  Short Peptide
RKKKLKKIPKFKHVAKKF

SEQ ID NO: 3744 - protein, 18 aa, Artificial
  Short Peptide
FKKKLKKIPKFKHVAKKF

SEQ ID NO: 3745 - protein, 18 aa, Artificial
  Short Peptide
KWKKLKKIPKFKHVAKKF

SEQ ID NO: 3746 - protein, 18 aa, Artificial
  Short Peptide
RWKKLKKIPKFKHVAKKF

SEQ ID NO: 3747 - protein, 18 aa, Artificial
  Short Peptide
FWKKLKKIPKFKHVAKKF

SEQ ID NO: 3748 - protein, 20 aa, Artificial
  Short Peptide
KKKLFLKIPPPKFLKVAKKF

SEQ ID NO: 3749 - protein, 20 aa, Artificial
  Short Peptide
RKKLFLKIPPPKFLKVAKKF

SEQ ID NO: 3750 - protein, 20 aa, Artificial
  Short Peptide
FKKLFLKIPPPKFLKVAKKF

SEQ ID NO: 3751 - protein, 20 aa, Artificial
  Short Peptide
KWKLFLKIPPPKFLKVAKKF

SEQ ID NO: 3752 - protein, 20 aa, Artificial
  Short Peptide
RWKLFLKIPPPKFLKVAKKF

SEQ ID NO: 3753 - protein, 20 aa, Artificial
  Short Peptide
FWKLFLKIPPPKFLKVAKKF

SEQ ID NO: 3754 - protein, 20 aa, Artificial
  Short Peptide
KKKKFLKIPPPKFLKVAKKF

SEQ ID NO: 3755 - protein, 20 aa, Artificial
  Short Peptide
RKKKFLKIPPPKFLKVAKKF

SEQ ID NO: 3756 - protein, 20 aa, Artificial
  Short Peptide
FKKKFLKIPPPKFLKVAKKF

SEQ ID NO: 3757 - protein, 20 aa, Artificial
  Short Peptide
KWKKFLKIPPPKFLKVAKKF

SEQ ID NO: 3758 - protein, 20 aa, Artificial
  Short Peptide
RWKKFLKIPPPKFLKVAKKF

SEQ ID NO: 3759 - protein, 20 aa, Artificial
  Short Peptide
FWKKFLKIPPPKFLKVAKKF

SEQ ID NO: 3760 - protein, 20 aa, Artificial
  Short Peptide
KKKLLLKIPPPKFLKVAKKF

SEQ ID NO: 3761 - protein, 20 aa, Artificial
  Short Peptide
RKKLLLKIPPPKFLKVAKKF

SEQ ID NO: 3762 - protein, 20 aa, Artificial
  Short Peptide
FKKLLLKIPPPKFLKVAKKF

SEQ ID NO: 3763 - protein, 20 aa, Artificial
  Short Peptide
KWKLLLKIPPPKFLKVAKKF

SEQ ID NO: 3764 - protein, 20 aa, Artificial
  Short Peptide
RWKLLLKIPPPKFLKVAKKF

SEQ ID NO: 3765 - protein, 20 aa, Artificial
  Short Peptide
FWKLLLKIPPPKFLKVAKKF

SEQ ID NO: 3766 - protein, 20 aa, Artificial
  Short Peptide
KKKKLLKIPPPKFLKVAKKF

SEQ ID NO: 3767 - protein, 20 aa, Artificial
  Short Peptide
RKKKLLKIPPPKFLKVAKKF

SEQ ID NO: 3768 - protein, 20 aa, Artificial
  Short Peptide
FKKKLLKIPPPKFLKVAKKF

SEQ ID NO: 3769 - protein, 20 aa, Artificial
  Short Peptide
KWKKLLKIPPPKFLKVAKKF

SEQ ID NO: 3770 - protein, 20 aa, Artificial
  Short Peptide
RWKKLLKIPPPKFLKVAKKF

SEQ ID NO: 3771 - protein, 20 aa, Artificial
  Short Peptide
FWKKLLKIPPPKFLKVAKKF

SEQ ID NO: 3772 - protein, 20 aa, Artificial
  Short Peptide
KKKLFKKIPPPKFLKVAKKF

SEQ ID NO: 3773 - protein, 20 aa, Artificial
  Short Peptide
RKKLFKKIPPPKFLKVAKKF

SEQ ID NO: 3774 - protein, 20 aa, Artificial
  Short Peptide
FKKLFKKIPPPKFLKVAKKF

SEQ ID NO: 3775 - protein, 20 aa, Artificial
  Short Peptide
KWKLFKKIPPPKFLKVAKKF

SEQ ID NO: 3776 - protein, 20 aa, Artificial
  Short Peptide
RWKLFKKIPPPKFLKVAKKF

SEQ ID NO: 3777 - protein, 20 aa, Artificial
  Short Peptide
FWKLFKKIPPPKFLKVAKKF

SEQ ID NO: 3778 - protein, 20 aa, Artificial
  Short Peptide
KKKKFKKIPPPKFLKVAKKF

SEQ ID NO: 3779 - protein, 20 aa, Artificial
  Short Peptide
RKKKFKKIPPPKFLKVAKKF

SEQ ID NO: 3780 - protein, 20 aa, Artificial
  Short Peptide
FKKKFKKIPPPKFLKVAKKF

SEQ ID NO: 3781 - protein, 20 aa, Artificial
  Short Peptide
KWKKFKKIPPPKFLKVAKKF

SEQ ID NO: 3782 - protein, 20 aa, Artificial
  Short Peptide
RWKKFKKIPPPKFLKVAKKF

SEQ ID NO: 3783 - protein, 20 aa, Artificial
  Short Peptide
FWKKFKKIPPPKFLKVAKKF

SEQ ID NO: 3784 - protein, 20 aa, Artificial
  Short Peptide
KKKLLKKIPPPKFLKVAKKF

SEQ ID NO: 3785 - protein, 20 aa, Artificial
  Short Peptide
RKKLLKKIPPPKFLKVAKKF

SEQ ID NO: 3786 - protein, 20 aa, Artificial
  Short Peptide
FKKLLKKIPPPKFLKVAKKF

SEQ ID NO: 3787 - protein, 20 aa, Artificial
  Short Peptide
KWKLLKKIPPPKFLKVAKKF

SEQ ID NO: 3788 - protein, 20 aa, Artificial
  Short Peptide
RWKLLKKIPPPKFLKVAKKF

SEQ ID NO: 3789 - protein, 20 aa, Artificial
  Short Peptide
FWKLLKKIPPPKFLKVAKKF

SEQ ID NO: 3790 - protein, 20 aa, Artificial
  Short Peptide
KKKKLKKIPPPKFLKVAKKF

SEQ ID NO: 3791 - protein, 20 aa, Artificial
  Short Peptide
RKKKLKKIPPPKFLKVAKKF

SEQ ID NO: 3792 - protein, 20 aa, Artificial
  Short Peptide
FKKKLKKIPPPKFLKVAKKF

SEQ ID NO: 3793 - protein, 20 aa, Artificial
  Short Peptide
KWKKLKKIPPPKFLKVAKKF

SEQ ID NO: 3794 - protein, 20 aa, Artificial
  Short Peptide
RWKKLKKIPPPKFLKVAKKF

SEQ ID NO: 3795 - protein, 20 aa, Artificial
  Short Peptide
FWKKLKKIPPPKFLKVAKKF

SEQ ID NO: 3796 - protein, 19 aa, Artificial
  Short Peptide
KKKLFLKIPPKFLKVAKKF

SEQ ID NO: 3797 - protein, 19 aa, Artificial
  Short Peptide
RKKLFLKIPPKFLKVAKKF

SEQ ID NO: 3798 - protein, 19 aa, Artificial
  Short Peptide
FKKLFLKIPPKFLKVAKKF

SEQ ID NO: 3799 - protein, 19 aa, Artificial
  Short Peptide
KWKLFLKIPPKFLKVAKKF

SEQ ID NO: 3800 - protein, 19 aa, Artificial
  Short Peptide
RWKLFLKIPPKFLKVAKKF

SEQ ID NO: 3801 - protein, 19 aa, Artificial
  Short Peptide
FWKLFLKIPPKFLKVAKKF

SEQ ID NO: 3802 - protein, 19 aa, Artificial
  Short Peptide
KKKKFLKIPPKFLKVAKKF

SEQ ID NO: 3803 - protein, 19 aa, Artificial
  Short Peptide
RKKKFLKIPPKFLKVAKKF

SEQ ID NO: 3804 - protein, 19 aa, Artificial
  Short Peptide
FKKKFLKIPPKFLKVAKKF

SEQ ID NO: 3805 - protein, 19 aa, Artificial
  Short Peptide
KWKKFLKIPPKFLKVAKKF

SEQ ID NO: 3806 - protein, 19 aa, Artificial
  Short Peptide
RWKKFLKIPPKFLKVAKKF

SEQ ID NO: 3807 - protein, 19 aa, Artificial
  Short Peptide
FWKKFLKIPPKFLKVAKKF

SEQ ID NO: 3808 - protein, 19 aa, Artificial
  Short Peptide
KKKLLLKIPPKFLKVAKKF

SEQ ID NO: 3809 - protein, 19 aa, Artificial
  Short Peptide
RKKLLLKIPPKFLKVAKKF

SEQ ID NO: 3810 - protein, 19 aa, Artificial
  Short Peptide
FKKLLLKIPPKFLKVAKKF

SEQ ID NO: 3811 - protein, 19 aa, Artificial
  Short Peptide
KWKLLLKIPPKFLKVAKKF

SEQ ID NO: 3812 - protein, 19 aa, Artificial
  Short Peptide
RWKLLLKIPPKFLKVAKKF

SEQ ID NO: 3813 - protein, 19 aa, Artificial
  Short Peptide
FWKLLLKIPPKFLKVAKKF

SEQ ID NO: 3814 - protein, 19 aa, Artificial
  Short Peptide
KKKKLLKIPPKFLKVAKKF

SEQ ID NO: 3815 - protein, 19 aa, Artificial
  Short Peptide
RKKKLLKIPPKFLKVAKKF

SEQ ID NO: 3816 - protein, 19 aa, Artificial
  Short Peptide
FKKKLLKIPPKFLKVAKKF

SEQ ID NO: 3817 - protein, 19 aa, Artificial
  Short Peptide
KWKKLLKIPPKFLKVAKKF

SEQ ID NO: 3818 - protein, 19 aa, Artificial
  Short Peptide
RWKKLLKIPPKFLKVAKKF

SEQ ID NO: 3819 - protein, 19 aa, Artificial
  Short Peptide
FWKKLLKIPPKFLKVAKKF

SEQ ID NO: 3820 - protein, 19 aa, Artificial
  Short Peptide
KKKLFKKIPPKFLKVAKKF

SEQ ID NO: 3821 - protein, 19 aa, Artificial
  Short Peptide
RKKLFKKIPPKFLKVAKKF

SEQ ID NO: 3822 - protein, 19 aa, Artificial
  Short Peptide
FKKLFKKIPPKFLKVAKKF

SEQ ID NO: 3823 - protein, 19 aa, Artificial
  Short Peptide
KWKLFKKIPPKFLKVAKKF

SEQ ID NO: 3824 - protein, 19 aa, Artificial
  Short Peptide
RWKLFKKIPPKFLKVAKKF

SEQ ID NO: 3825 - protein, 19 aa, Artificial
  Short Peptide
FWKLFKKIPPKFLKVAKKF

SEQ ID NO: 3826 - protein, 19 aa, Artificial
  Short Peptide
KKKKFKKIPPKFLKVAKKF

SEQ ID NO: 3827 - protein, 19 aa, Artificial
  Short Peptide
RKKKFKKIPPKFLKVAKKF

SEQ ID NO: 3828 - protein, 19 aa, Artificial
  Short Peptide
FKKKFKKIPPKFLKVAKKF

SEQ ID NO: 3829 - protein, 19 aa, Artificial
  Short Peptide
KWKKFKKIPPKFLKVAKKF

SEQ ID NO: 3830 - protein, 19 aa, Artificial
  Short Peptide
RWKKFKKIPPKFLKVAKKF

SEQ ID NO: 3831 - protein, 19 aa, Artificial
  Short Peptide
FWKKFKKIPPKFLKVAKKF

SEQ ID NO: 3832 - protein, 19 aa, Artificial
  Short Peptide
KKKLLKKIPPKFLKVAKKF

SEQ ID NO: 3833 - protein, 19 aa, Artificial
  Short Peptide
RKKLLKKIPPKFLKVAKKF

SEQ ID NO: 3834 - protein, 19 aa, Artificial
  Short Peptide
FKKLLKKIPPKFLKVAKKF

SEQ ID NO: 3835 - protein, 19 aa, Artificial
  Short Peptide
KWKLLKKIPPKFLKVAKKF

SEQ ID NO: 3836 - protein, 19 aa, Artificial
  Short Peptide
RWKLLKKIPPKFLKVAKKF

SEQ ID NO: 3837 - protein, 19 aa, Artificial
  Short Peptide
FWKLLKKIPPKFLKVAKKF

SEQ ID NO: 3838 - protein, 19 aa, Artificial
  Short Peptide
KKKKLKKIPPKFLKVAKKF

SEQ ID NO: 3839 - protein, 19 aa, Artificial
  Short Peptide
RKKKLKKIPPKFLKVAKKF

SEQ ID NO: 3840 - protein, 19 aa, Artificial
  Short Peptide
FKKKLKKIPPKFLKVAKKF

SEQ ID NO: 3841 - protein, 19 aa, Artificial
  Short Peptide
KWKKLKKIPPKFLKVAKKF

SEQ ID NO: 3842 - protein, 19 aa, Artificial
  Short Peptide
RWKKLKKIPPKFLKVAKKF

SEQ ID NO: 3843 - protein, 19 aa, Artificial
  Short Peptide
FWKKLKKIPPKFLKVAKKF

SEQ ID NO: 3844 - protein, 18 aa, Artificial
  Short Peptide
KKKLFLKIPKFLKVAKKF

SEQ ID NO: 3845 - protein, 18 aa, Artificial
  Short Peptide
RKKLFLKIPKFLKVAKKF

SEQ ID NO: 3846 - protein, 18 aa, Artificial
  Short Peptide
FKKLFLKIPKFLKVAKKF

SEQ ID NO: 3847 - protein, 18 aa, Artificial
  Short Peptide
KWKLFLKIPKFLKVAKKF

SEQ ID NO: 3848 - protein, 18 aa, Artificial
  Short Peptide
RWKLFLKIPKFLKVAKKF

SEQ ID NO: 3849 - protein, 18 aa, Artificial
  Short Peptide
FWKLFLKIPKFLKVAKKF

SEQ ID NO: 3850 - protein, 18 aa, Artificial
  Short Peptide
KKKKFLKIPKFLKVAKKF

SEQ ID NO: 3851 - protein, 18 aa, Artificial
  Short Peptide
RKKKFLKIPKFLKVAKKF

SEQ ID NO: 3852 - protein, 18 aa, Artificial
  Short Peptide
FKKKFLKIPKFLKVAKKF

SEQ ID NO: 3853 - protein, 18 aa, Artificial
  Short Peptide
KWKKFLKIPKFLKVAKKF

SEQ ID NO: 3854 - protein, 18 aa, Artificial
  Short Peptide
RWKKFLKIPKFLKVAKKF

SEQ ID NO: 3855 - protein, 18 aa, Artificial
  Short Peptide
FWKKFLKIPKFLKVAKKF

SEQ ID NO: 3856 - protein, 18 aa, Artificial
  Short Peptide
KKKLLLKIPKFLKVAKKF

SEQ ID NO: 3857 - protein, 18 aa, Artificial
  Short Peptide
RKKLLLKIPKFLKVAKKF

SEQ ID NO: 3858 - protein, 18 aa, Artificial
  Short Peptide
FKKLLLKIPKFLKVAKKF

SEQ ID NO: 3859 - protein, 18 aa, Artificial
  Short Peptide
KWKLLLKIPKFLKVAKKF

SEQ ID NO: 3860 - protein, 18 aa, Artificial
  Short Peptide
RWKLLLKIPKFLKVAKKF

SEQ ID NO: 3861 - protein, 18 aa, Artificial
  Short Peptide
FWKLLLKIPKFLKVAKKF

SEQ ID NO: 3862 - protein, 18 aa, Artificial
  Short Peptide
KKKKLLKIPKFLKVAKKF

SEQ ID NO: 3863 - protein, 18 aa, Artificial
  Short Peptide
RKKKLLKIPKFLKVAKKF

SEQ ID NO: 3864 - protein, 18 aa, Artificial
  Short Peptide
FKKKLLKIPKFLKVAKKF

SEQ ID NO: 3865 - protein, 18 aa, Artificial
  Short Peptide
KWKKLLKIPKFLKVAKKF

SEQ ID NO: 3866 - protein, 18 aa, Artificial
  Short Peptide
RWKKLLKIPKFLKVAKKF

SEQ ID NO: 3867 - protein, 18 aa, Artificial
  Short Peptide
FWKKLLKIPKFLKVAKKF

SEQ ID NO: 3868 - protein, 18 aa, Artificial
  Short Peptide
KKKLFKKIPKFLKVAKKF

SEQ ID NO: 3869 - protein, 18 aa, Artificial
  Short Peptide
RKKLFKKIPKFLKVAKKF

SEQ ID NO: 3870 - protein, 18 aa, Artificial
  Short Peptide
FKKLFKKIPKFLKVAKKF

SEQ ID NO: 3871 - protein, 18 aa, Artificial
  Short Peptide
KWKLFKKIPKFLKVAKKF

SEQ ID NO: 3872 - protein, 18 aa, Artificial
  Short Peptide
RWKLFKKIPKFLKVAKKF

SEQ ID NO: 3873 - protein, 18 aa, Artificial
  Short Peptide
FWKLFKKIPKFLKVAKKF

SEQ ID NO: 3874 - protein, 18 aa, Artificial
  Short Peptide
KKKKFKKIPKFLKVAKKF

SEQ ID NO: 3875 - protein, 18 aa, Artificial
  Short Peptide
RKKKFKKIPKFLKVAKKF

SEQ ID NO: 3876 - protein, 18 aa, Artificial
  Short Peptide
FKKKFKKIPKFLKVAKKF

SEQ ID NO: 3877 - protein, 18 aa, Artificial
  Short Peptide
KWKKFKKIPKFLKVAKKF

SEQ ID NO: 3878 - protein, 18 aa, Artificial
  Short Peptide
RWKKFKKIPKFLKVAKKF

SEQ ID NO: 3879 - protein, 18 aa, Artificial
  Short Peptide
FWKKFKKIPKFLKVAKKF

SEQ ID NO: 3880 - protein, 18 aa, Artificial
  Short Peptide
KKKLLKKIPKFLKVAKKF

SEQ ID NO: 3881 - protein, 18 aa, Artificial
  Short Peptide
RKKLLKKIPKFLKVAKKF

SEQ ID NO: 3882 - protein, 18 aa, Artificial
  Short Peptide
FKKLLKKIPKFLKVAKKF

SEQ ID NO: 3883 - protein, 18 aa, Artificial
  Short Peptide
KWKLLKKIPKFLKVAKKF

SEQ ID NO: 3884 - protein, 18 aa, Artificial
  Short Peptide
RWKLLKKIPKFLKVAKKF

SEQ ID NO: 3885 - protein, 18 aa, Artificial
  Short Peptide
FWKLLKKIPKFLKVAKKF

SEQ ID NO: 3886 - protein, 18 aa, Artificial
  Short Peptide
KKKKLKKIPKFLKVAKKF

SEQ ID NO: 3887 - protein, 18 aa, Artificial
  Short Peptide
RKKKLKKIPKFLKVAKKF

SEQ ID NO: 3888 - protein, 18 aa, Artificial
  Short Peptide
FKKKLKKIPKFLKVAKKF

SEQ ID NO: 3889 - protein, 18 aa, Artificial
  Short Peptide
KWKKLKKIPKFLKVAKKF

SEQ ID NO: 3890 - protein, 18 aa, Artificial
  Short Peptide
RWKKLKKIPKFLKVAKKF

SEQ ID NO: 3891 - protein, 18 aa, Artificial
  Short Peptide
FWKKLKKIPKFLKVAKKF

SEQ ID NO: 3892 - protein, 20 aa, Artificial
  Short Peptide
KKKLFLKIPPPKFKKVAKKF

SEQ ID NO: 3893 - protein, 20 aa, Artificial
  Short Peptide
RKKLFLKIPPPKFKKVAKKF

SEQ ID NO: 3894 - protein, 20 aa, Artificial
  Short Peptide
FKKLFLKIPPPKFKKVAKKF

SEQ ID NO: 3895 - protein, 20 aa, Artificial
  Short Peptide
KWKLFLKIPPPKFKKVAKKF

SEQ ID NO: 3896 - protein, 20 aa, Artificial
  Short Peptide
RWKLFLKIPPPKFKKVAKKF

SEQ ID NO: 3897 - protein, 20 aa, Artificial
  Short Peptide
FWKLFLKIPPPKFKKVAKKF

SEQ ID NO: 3898 - protein, 20 aa, Artificial
  Short Peptide
KKKKFLKIPPPKFKKVAKKF

SEQ ID NO: 3899 - protein, 20 aa, Artificial
  Short Peptide
RKKKFLKIPPPKFKKVAKKF

SEQ ID NO: 3900 - protein, 20 aa, Artificial
  Short Peptide
FKKKFLKIPPPKFKKVAKKF

SEQ ID NO: 3901 - protein, 20 aa, Artificial
  Short Peptide
KWKKFLKIPPPKFKKVAKKF

SEQ ID NO: 3902 - protein, 20 aa, Artificial
  Short Peptide
RWKKFLKIPPPKFKKVAKKF

SEQ ID NO: 3903 - protein, 20 aa, Artificial
  Short Peptide
FWKKFLKIPPPKFKKVAKKF

SEQ ID NO: 3904 - protein, 20 aa, Artificial
  Short Peptide
KKKLLLKIPPPKFKKVAKKF

SEQ ID NO: 3905 - protein, 20 aa, Artificial
  Short Peptide
RKKLLLKIPPPKFKKVAKKF

SEQ ID NO: 3906 - protein, 20 aa, Artificial
  Short Peptide
FKKLLLKIPPPKFKKVAKKF

SEQ ID NO: 3907 - protein, 20 aa, Artificial
  Short Peptide
KWKLLLKIPPPKFKKVAKKF

SEQ ID NO: 3908 - protein, 20 aa, Artificial
  Short Peptide
RWKLLLKIPPPKFKKVAKKF

SEQ ID NO: 3909 - protein, 20 aa, Artificial
  Short Peptide
FWKLLLKIPPPKFKKVAKKF

SEQ ID NO: 3910 - protein, 20 aa, Artificial
  Short Peptide
KKKKLLKIPPPKFKKVAKKF

SEQ ID NO: 3911 - protein, 20 aa, Artificial
  Short Peptide
RKKKLLKIPPPKFKKVAKKF

SEQ ID NO: 3912 - protein, 20 aa, Artificial
  Short Peptide
FKKKLLKIPPPKFKKVAKKF

SEQ ID NO: 3913 - protein, 20 aa, Artificial
  Short Peptide
KWKKLLKIPPPKFKKVAKKF

SEQ ID NO: 3914 - protein, 20 aa, Artificial
  Short Peptide
RWKKLLKIPPPKFKKVAKKF

SEQ ID NO: 3915 - protein, 20 aa, Artificial
  Short Peptide
FWKKLLKIPPPKFKKVAKKF

SEQ ID NO: 3916 - protein, 20 aa, Artificial
  Short Peptide
KKKLFKKIPPPKFKKVAKKF

SEQ ID NO: 3917 - protein, 20 aa, Artificial
  Short Peptide
RKKLFKKIPPPKFKKVAKKF

SEQ ID NO: 3918 - protein, 20 aa, Artificial
  Short Peptide
FKKLFKKIPPPKFKKVAKKF

SEQ ID NO: 3919 - protein, 20 aa, Artificial
  Short Peptide
KWKLFKKIPPPKFKKVAKKF

SEQ ID NO: 3920 - protein, 20 aa, Artificial
  Short Peptide
RWKLFKKIPPPKFKKVAKKF

SEQ ID NO: 3921 - protein, 20 aa, Artificial
  Short Peptide
FWKLFKKIPPPKFKKVAKKF

SEQ ID NO: 3922 - protein, 20 aa, Artificial
  Short Peptide
KKKKFKKIPPPKFKKVAKKF

SEQ ID NO: 3923 - protein, 20 aa, Artificial
  Short Peptide
RKKKFKKIPPPKFKKVAKKF

SEQ ID NO: 3924 - protein, 20 aa, Artificial
  Short Peptide
FKKKFKKIPPPKFKKVAKKF

SEQ ID NO: 3925 - protein, 20 aa, Artificial
  Short Peptide
KWKKFKKIPPPKFKKVAKKF

SEQ ID NO: 3926 - protein, 20 aa, Artificial
  Short Peptide
RWKKFKKIPPPKFKKVAKKF

SEQ ID NO: 3927 - protein, 20 aa, Artificial
  Short Peptide
FWKKFKKIPPPKFKKVAKKF

SEQ ID NO: 3928 - protein, 20 aa, Artificial
  Short Peptide
KKKLLKKIPPPKFKKVAKKF

SEQ ID NO: 3929 - protein, 20 aa, Artificial
  Short Peptide
RKKLLKKIPPPKFKKVAKKF

SEQ ID NO: 3930 - protein, 20 aa, Artificial
  Short Peptide
FKKLLKKIPPPKFKKVAKKF

SEQ ID NO: 3931 - protein, 20 aa, Artificial
  Short Peptide
KWKLLKKIPPPKFKKVAKKF

SEQ ID NO: 3932 - protein, 20 aa, Artificial
  Short Peptide
RWKLLKKIPPPKFKKVAKKF

SEQ ID NO: 3933 - protein, 20 aa, Artificial
  Short Peptide
FWKLLKKIPPPKFKKVAKKF

SEQ ID NO: 3934 - protein, 20 aa, Artificial
  Short Peptide
KKKKLKKIPPPKFKKVAKKF

SEQ ID NO: 3935 - protein, 20 aa, Artificial
  Short Peptide
RKKKLKKIPPPKFKKVAKKF

SEQ ID NO: 3936 - protein, 20 aa, Artificial
  Short Peptide
FKKKLKKIPPPKFKKVAKKF

SEQ ID NO: 3937 - protein, 20 aa, Artificial
  Short Peptide
KWKKLKKIPPPKFKKVAKKF

SEQ ID NO: 3938 - protein, 20 aa, Artificial
  Short Peptide
RWKKLKKIPPPKFKKVAKKF

SEQ ID NO: 3939 - protein, 20 aa, Artificial
  Short Peptide
FWKKLKKIPPPKFKKVAKKF

SEQ ID NO: 3940 - protein, 19 aa, Artificial
  Short Peptide
KKKLFLKIPPKFKKVAKKF

SEQ ID NO: 3941 - protein, 19 aa, Artificial
  Short Peptide
RKKLFLKIPPKFKKVAKKF

SEQ ID NO: 3942 - protein, 19 aa, Artificial
  Short Peptide
FKKLFLKIPPKFKKVAKKF

SEQ ID NO: 3943 - protein, 19 aa, Artificial
  Short Peptide
KWKLFLKIPPKFKKVAKKF

SEQ ID NO: 3944 - protein, 19 aa, Artificial
  Short Peptide
RWKLFLKIPPKFKKVAKKF

SEQ ID NO: 3945 - protein, 19 aa, Artificial
  Short Peptide
FWKLFLKIPPKFKKVAKKF

SEQ ID NO: 3946 - protein, 19 aa, Artificial
  Short Peptide
KKKKFLKIPPKFKKVAKKF

SEQ ID NO: 3947 - protein, 19 aa, Artificial
  Short Peptide
RKKKFLKIPPKFKKVAKKF

SEQ ID NO: 3948 - protein, 19 aa, Artificial
  Short Peptide
FKKKFLKIPPKFKKVAKKF

SEQ ID NO: 3949 - protein, 19 aa, Artificial
  Short Peptide
KWKKFLKIPPKFKKVAKKF

SEQ ID NO: 3950 - protein, 19 aa, Artificial
  Short Peptide
RWKKFLKIPPKFKKVAKKF

SEQ ID NO: 3951 - protein, 19 aa, Artificial
  Short Peptide
FWKKFLKIPPKFKKVAKKF

SEQ ID NO: 3952 - protein, 19 aa, Artificial
  Short Peptide
KKKLLLKIPPKFKKVAKKF

SEQ ID NO: 3953 - protein, 19 aa, Artificial
  Short Peptide
RKKLLLKIPPKFKKVAKKF

SEQ ID NO: 3954 - protein, 19 aa, Artificial
  Short Peptide
FKKLLLKIPPKFKKVAKKF

SEQ ID NO: 3955 - protein, 19 aa, Artificial
  Short Peptide
KWKLLLKIPPKFKKVAKKF

SEQ ID NO: 3956 - protein, 19 aa, Artificial
  Short Peptide
RWKLLLKIPPKFKKVAKKF

SEQ ID NO: 3957 - protein, 19 aa, Artificial
  Short Peptide
FWKLLLKIPPKFKKVAKKF

SEQ ID NO: 3958 - protein, 19 aa, Artificial
  Short Peptide
KKKKLLKIPPKFKKVAKKF

SEQ ID NO: 3959 - protein, 19 aa, Artificial
  Short Peptide
RKKKLLKIPPKFKKVAKKF

SEQ ID NO: 3960 - protein, 19 aa, Artificial
  Short Peptide
FKKKLLKIPPKFKKVAKKF

SEQ ID NO: 3961 - protein, 19 aa, Artificial
  Short Peptide
KWKKLLKIPPKFKKVAKKF

SEQ ID NO: 3962 - protein, 19 aa, Artificial
  Short Peptide
RWKKLLKIPPKFKKVAKKF

SEQ ID NO: 3963 - protein, 19 aa, Artificial
  Short Peptide
FWKKLLKIPPKFKKVAKKF

SEQ ID NO: 3964 - protein, 19 aa, Artificial
  Short Peptide
KKKLFKKIPPKFKKVAKKF

SEQ ID NO: 3965 - protein, 19 aa, Artificial
  Short Peptide
RKKLFKKIPPKFKKVAKKF

SEQ ID NO: 3966 - protein, 19 aa, Artificial
  Short Peptide
FKKLFKKIPPKFKKVAKKF

SEQ ID NO: 3967 - protein, 19 aa, Artificial
  Short Peptide
KWKLFKKIPPKFKKVAKKF

SEQ ID NO: 3968 - protein, 19 aa, Artificial
  Short Peptide
RWKLFKKIPPKFKKVAKKF

SEQ ID NO: 3969 - protein, 19 aa, Artificial
  Short Peptide
FWKLFKKIPPKFKKVAKKF

SEQ ID NO: 3970 - protein, 19 aa, Artificial
  Short Peptide
KKKKFKKIPPKFKKVAKKF

SEQ ID NO: 3971 - protein, 19 aa, Artificial
  Short Peptide
RKKKFKKIPPKFKKVAKKF

SEQ ID NO: 3972 - protein, 19 aa, Artificial
  Short Peptide
FKKKFKKIPPKFKKVAKKF

SEQ ID NO: 3973 - protein, 19 aa, Artificial
  Short Peptide
KWKKFKKIPPKFKKVAKKF

SEQ ID NO: 3974 - protein, 19 aa, Artificial
  Short Peptide
RWKKFKKIPPKFKKVAKKF

SEQ ID NO: 3975 - protein, 19 aa, Artificial
  Short Peptide
FWKKFKKIPPKFKKVAKKF

SEQ ID NO: 3976 - protein, 19 aa, Artificial
  Short Peptide
KKKLLKKIPPKFKKVAKKF

SEQ ID NO: 3977 - protein, 19 aa, Artificial
  Short Peptide
RKKLLKKIPPKFKKVAKKF

SEQ ID NO: 3978 - protein, 19 aa, Artificial
  Short Peptide
FKKLLKKIPPKFKKVAKKF

SEQ ID NO: 3979 - protein, 19 aa, Artificial
  Short Peptide
KWKLLKKIPPKFKKVAKKF

SEQ ID NO: 3980 - protein, 19 aa, Artificial
  Short Peptide
RWKLLKKIPPKFKKVAKKF

SEQ ID NO: 3981 - protein, 19 aa, Artificial
  Short Peptide
FWKLLKKIPPKFKKVAKKF

SEQ ID NO: 3982 - protein, 19 aa, Artificial
  Short Peptide
KKKKLKKIPPKFKKVAKKF

SEQ ID NO: 3983 - protein, 19 aa, Artificial
  Short Peptide
RKKKLKKIPPKFKKVAKKF

SEQ ID NO: 3984 - protein, 19 aa, Artificial
  Short Peptide
FKKKLKKIPPKFKKVAKKF

SEQ ID NO: 3985 - protein, 19 aa, Artificial
  Short Peptide
KWKKLKKIPPKFKKVAKKF

SEQ ID NO: 3986 - protein, 19 aa, Artificial
  Short Peptide
RWKKLKKIPPKFKKVAKKF

SEQ ID NO: 3987 - protein, 19 aa, Artificial
  Short Peptide
FWKKLKKIPPKFKKVAKKF

SEQ ID NO: 3988 - protein, 18 aa, Artificial
  Short Peptide
KKKLFLKIPKFKKVAKKF

SEQ ID NO: 3989 - protein, 18 aa, Artificial
  Short Peptide
RKKLFLKIPKFKKVAKKF

SEQ ID NO: 3990 - protein, 18 aa, Artificial
  Short Peptide
FKKLFLKIPKFKKVAKKF

SEQ ID NO: 3991 - protein, 18 aa, Artificial
  Short Peptide
KWKLFLKIPKFKKVAKKF

SEQ ID NO: 3992 - protein, 18 aa, Artificial
  Short Peptide
RWKLFLKIPKFKKVAKKF

SEQ ID NO: 3993 - protein, 18 aa, Artificial
  Short Peptide
FWKLFLKIPKFKKVAKKF

SEQ ID NO: 3994 - protein, 18 aa, Artificial
  Short Peptide
KKKKFLKIPKFKKVAKKF

SEQ ID NO: 3995 - protein, 18 aa, Artificial
  Short Peptide
RKKKFLKIPKFKKVAKKF

SEQ ID NO: 3996 - protein, 18 aa, Artificial
  Short Peptide
FKKKFLKIPKFKKVAKKF

SEQ ID NO: 3997 - protein, 18 aa, Artificial
  Short Peptide
KWKKFLKIPKFKKVAKKF

SEQ ID NO: 3998 - protein, 18 aa, Artificial
  Short Peptide
RWKKFLKIPKFKKVAKKF

SEQ ID NO: 3999 - protein, 18 aa, Artificial
  Short Peptide
FWKKFLKIPKFKKVAKKF

SEQ ID NO: 4000 - protein, 18 aa, Artificial
  Short Peptide
KKKLLLKIPKFKKVAKKF

SEQ ID NO: 4001 - protein, 18 aa, Artificial
  Short Peptide
RKKLLLKIPKFKKVAKKF

SEQ ID NO: 4002 - protein, 18 aa, Artificial
  Short Peptide
FKKLLLKIPKFKKVAKKF

SEQ ID NO: 4003 - protein, 18 aa, Artificial
  Short Peptide
KWKLLLKIPKFKKVAKKF

SEQ ID NO: 4004 - protein, 18 aa, Artificial
  Short Peptide
RWKLLLKIPKFKKVAKKF

SEQ ID NO: 4005 - protein, 18 aa, Artificial
  Short Peptide
FWKLLLKIPKFKKVAKKF

SEQ ID NO: 4006 - protein, 18 aa, Artificial
  Short Peptide
KKKKLLKIPKFKKVAKKF

SEQ ID NO: 4007 - protein, 18 aa, Artificial
  Short Peptide
RKKKLLKIPKFKKVAKKF

SEQ ID NO: 4008 - protein, 18 aa, Artificial
  Short Peptide
FKKKLLKIPKFKKVAKKF

SEQ ID NO: 4009 - protein, 18 aa, Artificial
  Short Peptide
KWKKLLKIPKFKKVAKKF

SEQ ID NO: 4010 - protein, 18 aa, Artificial
  Short Peptide
RWKKLLKIPKFKKVAKKF

SEQ ID NO: 4011 - protein, 18 aa, Artificial
  Short Peptide
FWKKLLKIPKFKKVAKKF

SEQ ID NO: 4012 - protein, 18 aa, Artificial
  Short Peptide
KKKLFKKIPKFKKVAKKF

SEQ ID NO: 4013 - protein, 18 aa, Artificial
  Short Peptide
RKKLFKKIPKFKKVAKKF

SEQ ID NO: 4014 - protein, 18 aa, Artificial
  Short Peptide
FKKLFKKIPKFKKVAKKF

SEQ ID NO: 4015 - protein, 18 aa, Artificial
  Short Peptide
KWKLFKKIPKFKKVAKKF

SEQ ID NO: 4016 - protein, 18 aa, Artificial
  Short Peptide
RWKLFKKIPKFKKVAKKF

SEQ ID NO: 4017 - protein, 18 aa, Artificial
  Short Peptide
FWKLFKKIPKFKKVAKKF

SEQ ID NO: 4018 - protein, 18 aa, Artificial
  Short Peptide
KKKKFKKIPKFKKVAKKF

SEQ ID NO: 4019 - protein, 18 aa, Artificial
  Short Peptide
RKKKFKKIPKFKKVAKKF

SEQ ID NO: 4020 - protein, 18 aa, Artificial
  Short Peptide
FKKKFKKIPKFKKVAKKF

SEQ ID NO: 4021 - protein, 18 aa, Artificial
  Short Peptide
KWKKFKKIPKFKKVAKKF

SEQ ID NO: 4022 - protein, 18 aa, Artificial
  Short Peptide
RWKKFKKIPKFKKVAKKF

SEQ ID NO: 4023 - protein, 18 aa, Artificial
  Short Peptide
FWKKFKKIPKFKKVAKKF

SEQ ID NO: 4024 - protein, 18 aa, Artificial
  Short Peptide
KKKLLKKIPKFKKVAKKF

SEQ ID NO: 4025 - protein, 18 aa, Artificial
  Short Peptide
RKKLLKKIPKFKKVAKKF

SEQ ID NO: 4026 - protein, 18 aa, Artificial
  Short Peptide
FKKLLKKIPKFKKVAKKF

SEQ ID NO: 4027 - protein, 18 aa, Artificial
  Short Peptide
KWKLLKKIPKFKKVAKKF

SEQ ID NO: 4028 - protein, 18 aa, Artificial
  Short Peptide
RWKLLKKIPKFKKVAKKF

SEQ ID NO: 4029 - protein, 18 aa, Artificial
  Short Peptide
FWKLLKKIPKFKKVAKKF

SEQ ID NO: 4030 - protein, 18 aa, Artificial
  Short Peptide
KKKKLKKIPKFKKVAKKF

SEQ ID NO: 4031 - protein, 18 aa, Artificial
  Short Peptide
RKKKLKKIPKFKKVAKKF

SEQ ID NO: 4032 - protein, 18 aa, Artificial
  Short Peptide
FKKKLKKIPKFKKVAKKF

SEQ ID NO: 4033 - protein, 18 aa, Artificial
  Short Peptide
KWKKLKKIPKFKKVAKKF

SEQ ID NO: 4034 - protein, 18 aa, Artificial
  Short Peptide
RWKKLKKIPKFKKVAKKF

SEQ ID NO: 4035 - protein, 18 aa, Artificial
  Short Peptide
FWKKLKKIPKFKKVAKKF

SEQ ID NO: 4036 - protein, 20 aa, Artificial
  Short Peptide
KKKLFLKIPPPKFLHSAKKF

SEQ ID NO: 4037 - protein, 20 aa, Artificial
  Short Peptide
RKKLFLKIPPPKFLHSAKKF

SEQ ID NO: 4038 - protein, 20 aa, Artificial
  Short Peptide
FKKLFLKIPPPKFLHSAKKF

SEQ ID NO: 4039 - protein, 20 aa, Artificial
  Short Peptide
KWKLFLKIPPPKFLHSAKKF

SEQ ID NO: 4040 - protein, 20 aa, Artificial
  Short Peptide
RWKLFLKIPPPKFLHSAKKF

SEQ ID NO: 4041 - protein, 20 aa, Artificial
  Short Peptide
FWKLFLKIPPPKFLHSAKKF

SEQ ID NO: 4042 - protein, 20 aa, Artificial
  Short Peptide
KKKKFLKIPPPKFLHSAKKF

SEQ ID NO: 4043 - protein, 20 aa, Artificial
  Short Peptide
RKKKFLKIPPPKFLHSAKKF

SEQ ID NO: 4044 - protein, 20 aa, Artificial
  Short Peptide
FKKKFLKIPPPKFLHSAKKF

SEQ ID NO: 4045 - protein, 20 aa, Artificial
  Short Peptide
KWKKFLKIPPPKFLHSAKKF

SEQ ID NO: 4046 - protein, 20 aa, Artificial
  Short Peptide
RWKKFLKIPPPKFLHSAKKF

SEQ ID NO: 4047 - protein, 20 aa, Artificial
  Short Peptide
FWKKFLKIPPPKFLHSAKKF

SEQ ID NO: 4048 - protein, 20 aa, Artificial
  Short Peptide
KKKLLLKIPPPKFLHSAKKF

SEQ ID NO: 4049 - protein, 20 aa, Artificial
  Short Peptide
RKKLLLKIPPPKFLHSAKKF

SEQ ID NO: 4050 - protein, 20 aa, Artificial
  Short Peptide
FKKLLLKIPPPKFLHSAKKF

SEQ ID NO: 4051 - protein, 20 aa, Artificial
  Short Peptide
KWKLLLKIPPPKFLHSAKKF

SEQ ID NO: 4052 - protein, 20 aa, Artificial
  Short Peptide
RWKLLLKIPPPKFLHSAKKF

SEQ ID NO: 4053 - protein, 20 aa, Artificial
  Short Peptide
FWKLLLKIPPPKFLHSAKKF

SEQ ID NO: 4054 - protein, 20 aa, Artificial
  Short Peptide
KKKKLLKIPPPKFLHSAKKF

SEQ ID NO: 4055 - protein, 20 aa, Artificial
  Short Peptide
RKKKLLKIPPPKFLHSAKKF

SEQ ID NO: 4056 - protein, 20 aa, Artificial
  Short Peptide
FKKKLLKIPPPKFLHSAKKF

SEQ ID NO: 4057 - protein, 20 aa, Artificial
  Short Peptide
KWKKLLKIPPPKFLHSAKKF

SEQ ID NO: 4058 - protein, 20 aa, Artificial
  Short Peptide
RWKKLLKIPPPKFLHSAKKF

SEQ ID NO: 4059 - protein, 20 aa, Artificial
  Short Peptide
FWKKLLKIPPPKFLHSAKKF

SEQ ID NO: 4060 - protein, 20 aa, Artificial
  Short Peptide
KKKLFKKIPPPKFLHSAKKF

SEQ ID NO: 4061 - protein, 20 aa, Artificial
  Short Peptide
RKKLFKKIPPPKFLHSAKKF

SEQ ID NO: 4062 - protein, 20 aa, Artificial
  Short Peptide
FKKLFKKIPPPKFLHSAKKF

SEQ ID NO: 4063 - protein, 20 aa, Artificial
  Short Peptide
KWKLFKKIPPPKFLHSAKKF

SEQ ID NO: 4064 - protein, 20 aa, Artificial
  Short Peptide
RWKLFKKIPPPKFLHSAKKF

SEQ ID NO: 4065 - protein, 20 aa, Artificial
  Short Peptide
FWKLFKKIPPPKFLHSAKKF

SEQ ID NO: 4066 - protein, 20 aa, Artificial
  Short Peptide
KKKKFKKIPPPKFLHSAKKF

SEQ ID NO: 4067 - protein, 20 aa, Artificial
  Short Peptide
RKKKFKKIPPPKFLHSAKKF

SEQ ID NO: 4068 - protein, 20 aa, Artificial
  Short Peptide
FKKKFKKIPPPKFLHSAKKF

SEQ ID NO: 4069 - protein, 20 aa, Artificial
  Short Peptide
KWKKFKKIPPPKFLHSAKKF

SEQ ID NO: 4070 - protein, 20 aa, Artificial
  Short Peptide
RWKKFKKIPPPKFLHSAKKF

SEQ ID NO: 4071 - protein, 20 aa, Artificial
  Short Peptide
FWKKFKKIPPPKFLHSAKKF

SEQ ID NO: 4072 - protein, 20 aa, Artificial
  Short Peptide
KKKLLKKIPPPKFLHSAKKF

SEQ ID NO: 4073 - protein, 20 aa, Artificial
  Short Peptide
RKKLLKKIPPPKFLHSAKKF

SEQ ID NO: 4074 - protein, 20 aa, Artificial
  Short Peptide
FKKLLKKIPPPKFLHSAKKF

SEQ ID NO: 4075 - protein, 20 aa, Artificial
  Short Peptide
KWKLLKKIPPPKFLHSAKKF

SEQ ID NO: 4076 - protein, 20 aa, Artificial
  Short Peptide
RWKLLKKIPPPKFLHSAKKF

SEQ ID NO: 4077 - protein, 20 aa, Artificial
  Short Peptide
FWKLLKKIPPPKFLHSAKKF

SEQ ID NO: 4078 - protein, 20 aa, Artificial
  Short Peptide
KKKKLKKIPPPKFLHSAKKF

SEQ ID NO: 4079 - protein, 20 aa, Artificial
  Short Peptide
RKKKLKKIPPPKFLHSAKKF

SEQ ID NO: 4080 - protein, 20 aa, Artificial
  Short Peptide
FKKKLKKIPPPKFLHSAKKF

SEQ ID NO: 4081 - protein, 20 aa, Artificial
  Short Peptide
KWKKLKKIPPPKFLHSAKKF

SEQ ID NO: 4082 - protein, 20 aa, Artificial
  Short Peptide
RWKKLKKIPPPKFLHSAKKF

SEQ ID NO: 4083 - protein, 20 aa, Artificial
  Short Peptide
FWKKLKKIPPPKFLHSAKKF

SEQ ID NO: 4084 - protein, 19 aa, Artificial
  Short Peptide
KKKLFLKIPPKFLHSAKKF

SEQ ID NO: 4085 - protein, 19 aa, Artificial
  Short Peptide
RKKLFLKIPPKFLHSAKKF

SEQ ID NO: 4086 - protein, 19 aa, Artificial
  Short Peptide
FKKLFLKIPPKFLHSAKKF

SEQ ID NO: 4087 - protein, 19 aa, Artificial
  Short Peptide
KWKLFLKIPPKFLHSAKKF

SEQ ID NO: 4088 - protein, 19 aa, Artificial
  Short Peptide
RWKLFLKIPPKFLHSAKKF

SEQ ID NO: 4089 - protein, 19 aa, Artificial
  Short Peptide
FWKLFLKIPPKFLHSAKKF

SEQ ID NO: 4090 - protein, 19 aa, Artificial
  Short Peptide
KKKKFLKIPPKFLHSAKKF

SEQ ID NO: 4091 - protein, 19 aa, Artificial
  Short Peptide
RKKKFLKIPPKFLHSAKKF

SEQ ID NO: 4092 - protein, 19 aa, Artificial
  Short Peptide
FKKKFLKIPPKFLHSAKKF

SEQ ID NO: 4093 - protein, 19 aa, Artificial
  Short Peptide
KWKKFLKIPPKFLHSAKKF

SEQ ID NO: 4094 - protein, 19 aa, Artificial
  Short Peptide
RWKKFLKIPPKFLHSAKKF

SEQ ID NO: 4095 - protein, 19 aa, Artificial
  Short Peptide
FWKKFLKIPPKFLHSAKKF

SEQ ID NO: 4096 - protein, 19 aa, Artificial
  Short Peptide
KKKLLLKIPPKFLHSAKKF

SEQ ID NO: 4097 - protein, 19 aa, Artificial
  Short Peptide
RKKLLLKIPPKFLHSAKKF

SEQ ID NO: 4098 - protein, 19 aa, Artificial
  Short Peptide
FKKLLLKIPPKFLHSAKKF

SEQ ID NO: 4099 - protein, 19 aa, Artificial
  Short Peptide
KWKLLLKIPPKFLHSAKKF

SEQ ID NO: 4100 - protein, 19 aa, Artificial
  Short Peptide
RWKLLLKIPPKFLHSAKKF

SEQ ID NO: 4101 - protein, 19 aa, Artificial
  Short Peptide
FWKLLLKIPPKFLHSAKKF

SEQ ID NO: 4102 - protein, 19 aa, Artificial
  Short Peptide
KKKKLLKIPPKFLHSAKKF

SEQ ID NO: 4103 - protein, 19 aa, Artificial
  Short Peptide
RKKKLLKIPPKFLHSAKKF

SEQ ID NO: 4104 - protein, 19 aa, Artificial
  Short Peptide
FKKKLLKIPPKFLHSAKKF

SEQ ID NO: 4105 - protein, 19 aa, Artificial
  Short Peptide
KWKKLLKIPPKFLHSAKKF

SEQ ID NO: 4106 - protein, 19 aa, Artificial
  Short Peptide
RWKKLLKIPPKFLHSAKKF

SEQ ID NO: 4107 - protein, 19 aa, Artificial
  Short Peptide
FWKKLLKIPPKFLHSAKKF

SEQ ID NO: 4108 - protein, 19 aa, Artificial
  Short Peptide
KKKLFKKIPPKFLHSAKKF

SEQ ID NO: 4109 - protein, 19 aa, Artificial
  Short Peptide
RKKLFKKIPPKFLHSAKKF

SEQ ID NO: 4110 - protein, 19 aa, Artificial
  Short Peptide
FKKLFKKIPPKFLHSAKKF

SEQ ID NO: 4111 - protein, 19 aa, Artificial
  Short Peptide
KWKLFKKIPPKFLHSAKKF

SEQ ID NO: 4112 - protein, 19 aa, Artificial
  Short Peptide
RWKLFKKIPPKFLHSAKKF

SEQ ID NO: 4113 - protein, 19 aa, Artificial
  Short Peptide
FWKLFKKIPPKFLHSAKKF

SEQ ID NO: 4114 - protein, 19 aa, Artificial
  Short Peptide
KKKKFKKIPPKFLHSAKKF

SEQ ID NO: 4115 - protein, 19 aa, Artificial
  Short Peptide
RKKKFKKIPPKFLHSAKKF

SEQ ID NO: 4116 - protein, 19 aa, Artificial
  Short Peptide
FKKKFKKIPPKFLHSAKKF

SEQ ID NO: 4117 - protein, 19 aa, Artificial
  Short Peptide
KWKKFKKIPPKFLHSAKKF

SEQ ID NO: 4118 - protein, 19 aa, Artificial
  Short Peptide
RWKKFKKIPPKFLHSAKKF

SEQ ID NO: 4119 - protein, 19 aa, Artificial
  Short Peptide
FWKKFKKIPPKFLHSAKKF

SEQ ID NO: 4120 - protein, 19 aa, Artificial
  Short Peptide
KKKLLKKIPPKFLHSAKKF

SEQ ID NO: 4121 - protein, 19 aa, Artificial
  Short Peptide
RKKLLKKIPPKFLHSAKKF

SEQ ID NO: 4122 - protein, 19 aa, Artificial
  Short Peptide
FKKLLKKIPPKFLHSAKKF

SEQ ID NO: 4123 - protein, 19 aa, Artificial
  Short Peptide
KWKLLKKIPPKFLHSAKKF

SEQ ID NO: 4124 - protein, 19 aa, Artificial
  Short Peptide
RWKLLKKIPPKFLHSAKKF

SEQ ID NO: 4125 - protein, 19 aa, Artificial
  Short Peptide
FWKLLKKIPPKFLHSAKKF

SEQ ID NO: 4126 - protein, 19 aa, Artificial
  Short Peptide
KKKKLKKIPPKFLHSAKKF

SEQ ID NO: 4127 - protein, 19 aa, Artificial
  Short Peptide
RKKKLKKIPPKFLHSAKKF

SEQ ID NO: 4128 - protein, 19 aa, Artificial
  Short Peptide
FKKKLKKIPPKFLHSAKKF

SEQ ID NO: 4129 - protein, 19 aa, Artificial
  Short Peptide
KWKKLKKIPPKFLHSAKKF

SEQ ID NO: 4130 - protein, 19 aa, Artificial
  Short Peptide
RWKKLKKIPPKFLHSAKKF

SEQ ID NO: 4131 - protein, 19 aa, Artificial
  Short Peptide
FWKKLKKIPPKFLHSAKKF

SEQ ID NO: 4132 - protein, 18 aa, Artificial
  Short Peptide
KKKLFLKIPKFLHSAKKF

SEQ ID NO: 4133 - protein, 18 aa, Artificial
  Short Peptide
RKKLFLKIPKFLHSAKKF

SEQ ID NO: 4134 - protein, 18 aa, Artificial
  Short Peptide
FKKLFLKIPKFLHSAKKF

SEQ ID NO: 4135 - protein, 18 aa, Artificial
  Short Peptide
KWKLFLKIPKFLHSAKKF

SEQ ID NO: 4136 - protein, 18 aa, Artificial
  Short Peptide
RWKLFLKIPKFLHSAKKF

SEQ ID NO: 4137 - protein, 18 aa, Artificial
  Short Peptide
FWKLFLKIPKFLHSAKKF

SEQ ID NO: 4138 - protein, 18 aa, Artificial
  Short Peptide
KKKKFLKIPKFLHSAKKF

SEQ ID NO: 4139 - protein, 18 aa, Artificial
  Short Peptide
RKKKFLKIPKFLHSAKKF

SEQ ID NO: 4140 - protein, 18 aa, Artificial
  Short Peptide
FKKKFLKIPKFLHSAKKF

SEQ ID NO: 4141 - protein, 18 aa, Artificial
  Short Peptide
KWKKFLKIPKFLHSAKKF

SEQ ID NO: 4142 - protein, 18 aa, Artificial
  Short Peptide
RWKKFLKIPKFLHSAKKF

SEQ ID NO: 4143 - protein, 18 aa, Artificial
  Short Peptide
FWKKFLKIPKFLHSAKKF

SEQ ID NO: 4144 - protein, 18 aa, Artificial
  Short Peptide
KKKLLLKIPKFLHSAKKF

SEQ ID NO: 4145 - protein, 18 aa, Artificial
  Short Peptide
RKKLLLKIPKFLHSAKKF

SEQ ID NO: 4146 - protein, 18 aa, Artificial
  Short Peptide
FKKLLLKIPKFLHSAKKF

SEQ ID NO: 4147 - protein, 18 aa, Artificial
  Short Peptide
KWKLLLKIPKFLHSAKKF

SEQ ID NO: 4148 - protein, 18 aa, Artificial
  Short Peptide
RWKLLLKIPKFLHSAKKF

SEQ ID NO: 4149 - protein, 18 aa, Artificial
  Short Peptide
FWKLLLKIPKFLHSAKKF

SEQ ID NO: 4150 - protein, 18 aa, Artificial
  Short Peptide
KKKKLLKIPKFLHSAKKF

SEQ ID NO: 4151 - protein, 18 aa, Artificial
  Short Peptide
RKKKLLKIPKFLHSAKKF

SEQ ID NO: 4152 - protein, 18 aa, Artificial
  Short Peptide
FKKKLLKIPKFLHSAKKF

SEQ ID NO: 4153 - protein, 18 aa, Artificial
  Short Peptide
KWKKLLKIPKFLHSAKKF

SEQ ID NO: 4154 - protein, 18 aa, Artificial
  Short Peptide
RWKKLLKIPKFLHSAKKF

SEQ ID NO: 4155 - protein, 18 aa, Artificial
  Short Peptide
FWKKLLKIPKFLHSAKKF

SEQ ID NO: 4156 - protein, 18 aa, Artificial
  Short Peptide
KKKLFKKIPKFLHSAKKF

SEQ ID NO: 4157 - protein, 18 aa, Artificial
  Short Peptide
RKKLFKKIPKFLHSAKKF

SEQ ID NO: 4158 - protein, 18 aa, Artificial
  Short Peptide
FKKLFKKIPKFLHSAKKF

SEQ ID NO: 4159 - protein, 17 aa, Artificial
  Short Peptide
KWKLFKKIPKFLHSAKK

SEQ ID NO: 4160 - protein, 18 aa, Artificial
  Short Peptide
RWKLFKKIPKFLHSAKKF

SEQ ID NO: 4161 - protein, 18 aa, Artificial
  Short Peptide
FWKLFKKIPKFLHSAKKF

SEQ ID NO: 4162 - protein, 18 aa, Artificial
  Short Peptide
KKKKFKKIPKFLHSAKKF

SEQ ID NO: 4163 - protein, 18 aa, Artificial
  Short Peptide
RKKKFKKIPKFLHSAKKF

SEQ ID NO: 4164 - protein, 18 aa, Artificial
  Short Peptide
FKKKFKKIPKFLHSAKKF

SEQ ID NO: 4165 - protein, 18 aa, Artificial
  Short Peptide
KWKKFKKIPKFLHSAKKF

SEQ ID NO: 4166 - protein, 18 aa, Artificial
  Short Peptide
RWKKFKKIPKFLHSAKKF

SEQ ID NO: 4167 - protein, 18 aa, Artificial
  Short Peptide
FWKKFKKIPKFLHSAKKF

SEQ ID NO: 4168 - protein, 18 aa, Artificial
  Short Peptide
KKKLLKKIPKFLHSAKKF

SEQ ID NO: 4169 - protein, 18 aa, Artificial
  Short Peptide
RKKLLKKIPKFLHSAKKF

SEQ ID NO: 4170 - protein, 18 aa, Artificial
  Short Peptide
FKKLLKKIPKFLHSAKKF

SEQ ID NO: 4171 - protein, 18 aa, Artificial
  Short Peptide
KWKLLKKIPKFLHSAKKF

SEQ ID NO: 4172 - protein, 18 aa, Artificial
  Short Peptide
RWKLLKKIPKFLHSAKKF

SEQ ID NO: 4173 - protein, 18 aa, Artificial
  Short Peptide
FWKLLKKIPKFLHSAKKF

SEQ ID NO: 4174 - protein, 18 aa, Artificial
  Short Peptide
KKKKLKKIPKFLHSAKKF

SEQ ID NO: 4175 - protein, 18 aa, Artificial
  Short Peptide
RKKKLKKIPKFLHSAKKF

SEQ ID NO: 4176 - protein, 18 aa, Artificial
  Short Peptide
FKKKLKKIPKFLHSAKKF

SEQ ID NO: 4177 - protein, 18 aa, Artificial
  Short Peptide
KWKKLKKIPKFLHSAKKF

SEQ ID NO: 4178 - protein, 18 aa, Artificial
  Short Peptide
RWKKLKKIPKFLHSAKKF

SEQ ID NO: 4179 - protein, 18 aa, Artificial
  Short Peptide
FWKKLKKIPKFLHSAKKF

SEQ ID NO: 4180 - protein, 20 aa, Artificial
  Short Peptide
KKKLFLKIPPPKFKHSAKKF

SEQ ID NO: 4181 - protein, 20 aa, Artificial
  Short Peptide
RKKLFLKIPPPKFKHSAKKF

SEQ ID NO: 4182 - protein, 20 aa, Artificial
  Short Peptide
FKKLFLKIPPPKFKHSAKKF

SEQ ID NO: 4183 - protein, 20 aa, Artificial
  Short Peptide
KWKLFLKIPPPKFKHSAKKF

SEQ ID NO: 4184 - protein, 20 aa, Artificial
  Short Peptide
RWKLFLKIPPPKFKHSAKKF

SEQ ID NO: 4185 - protein, 20 aa, Artificial
  Short Peptide
FWKLFLKIPPPKFKHSAKKF

SEQ ID NO: 4186 - protein, 20 aa, Artificial
  Short Peptide
KKKKFLKIPPPKFKHSAKKF

SEQ ID NO: 4187 - protein, 20 aa, Artificial
  Short Peptide
RKKKFLKIPPPKFKHSAKKF

SEQ ID NO: 4188 - protein, 20 aa, Artificial
  Short Peptide
FKKKFLKIPPPKFKHSAKKF

SEQ ID NO: 4189 - protein, 20 aa, Artificial
  Short Peptide
KWKKFLKIPPPKFKHSAKKF

SEQ ID NO: 4190 - protein, 20 aa, Artificial
  Short Peptide
RWKKFLKIPPPKFKHSAKKF

SEQ ID NO: 4191 - protein, 20 aa, Artificial
  Short Peptide
FWKKFLKIPPPKFKHSAKKF

SEQ ID NO: 4192 - protein, 20 aa, Artificial
  Short Peptide
KKKLLLKIPPPKFKHSAKKF

SEQ ID NO: 4193 - protein, 20 aa, Artificial
  Short Peptide
RKKLLLKIPPPKFKHSAKKF

SEQ ID NO: 4194 - protein, 20 aa, Artificial
  Short Peptide
FKKLLLKIPPPKFKHSAKKF

SEQ ID NO: 4195 - protein, 20 aa, Artificial
  Short Peptide
KWKLLLKIPPPKFKHSAKKF

SEQ ID NO: 4196 - protein, 20 aa, Artificial
  Short Peptide
RWKLLLKIPPPKFKHSAKKF

SEQ ID NO: 4197 - protein, 20 aa, Artificial
  Short Peptide
FWKLLLKIPPPKFKHSAKKF

SEQ ID NO: 4198 - protein, 20 aa, Artificial
  Short Peptide
KKKKLLKIPPPKFKHSAKKF

SEQ ID NO: 4199 - protein, 20 aa, Artificial
  Short Peptide
RKKKLLKIPPPKFKHSAKKF

SEQ ID NO: 4200 - protein, 20 aa, Artificial
  Short Peptide
FKKKLLKIPPPKFKHSAKKF

SEQ ID NO: 4201 - protein, 20 aa, Artificial
  Short Peptide
KWKKLLKIPPPKFKHSAKKF

SEQ ID NO: 4202 - protein, 20 aa, Artificial
  Short Peptide
RWKKLLKIPPPKFKHSAKKF

SEQ ID NO: 4203 - protein, 20 aa, Artificial
  Short Peptide
FWKKLLKIPPPKFKHSAKKF

SEQ ID NO: 4204 - protein, 20 aa, Artificial
  Short Peptide
KKKLFKKIPPPKFKHSAKKF

SEQ ID NO: 4205 - protein, 20 aa, Artificial
  Short Peptide
RKKLFKKIPPPKFKHSAKKF

SEQ ID NO: 4206 - protein, 20 aa, Artificial
  Short Peptide
FKKLFKKIPPPKFKHSAKKF

SEQ ID NO: 4207 - protein, 20 aa, Artificial
  Short Peptide
KWKLFKKIPPPKFKHSAKKF

SEQ ID NO: 4208 - protein, 20 aa, Artificial
  Short Peptide
RWKLFKKIPPPKFKHSAKKF

SEQ ID NO: 4209 - protein, 20 aa, Artificial
  Short Peptide
FWKLFKKIPPPKFKHSAKKF

SEQ ID NO: 4210 - protein, 20 aa, Artificial
  Short Peptide
KKKKFKKIPPPKFKHSAKKF

SEQ ID NO: 4211 - protein, 20 aa, Artificial
  Short Peptide
RKKKFKKIPPPKFKHSAKKF

SEQ ID NO: 4212 - protein, 20 aa, Artificial
  Short Peptide
FKKKFKKIPPPKFKHSAKKF

SEQ ID NO: 4213 - protein, 20 aa, Artificial
  Short Peptide
KWKKFKKIPPPKFKHSAKKF

SEQ ID NO: 4214 - protein, 20 aa, Artificial
  Short Peptide
RWKKFKKIPPPKFKHSAKKF

SEQ ID NO: 4215 - protein, 20 aa, Artificial
  Short Peptide
FWKKFKKIPPPKFKHSAKKF

SEQ ID NO: 4216 - protein, 20 aa, Artificial
  Short Peptide
KKKLLKKIPPPKFKHSAKKF

SEQ ID NO: 4217 - protein, 20 aa, Artificial
  Short Peptide
RKKLLKKIPPPKFKHSAKKF

SEQ ID NO: 4218 - protein, 20 aa, Artificial
  Short Peptide
FKKLLKKIPPPKFKHSAKKF

SEQ ID NO: 4219 - protein, 20 aa, Artificial
  Short Peptide
KWKLLKKIPPPKFKHSAKKF

SEQ ID NO: 4220 - protein, 20 aa, Artificial
  Short Peptide
RWKLLKKIPPPKFKHSAKKF

SEQ ID NO: 4221 - protein, 20 aa, Artificial
  Short Peptide
FWKLLKKIPPPKFKHSAKKF

SEQ ID NO: 4222 - protein, 20 aa, Artificial
  Short Peptide
KKKKLKKIPPPKFKHSAKKF

SEQ ID NO: 4223 - protein, 20 aa, Artificial
  Short Peptide
RKKKLKKIPPPKFKHSAKKF

SEQ ID NO: 4224 - protein, 20 aa, Artificial
  Short Peptide
FKKKLKKIPPPKFKHSAKKF

SEQ ID NO: 4225 - protein, 20 aa, Artificial
  Short Peptide
KWKKLKKIPPPKFKHSAKKF

SEQ ID NO: 4226 - protein, 20 aa, Artificial
  Short Peptide
RWKKLKKIPPPKFKHSAKKF

SEQ ID NO: 4227 - protein, 20 aa, Artificial
  Short Peptide
FWKKLKKIPPPKFKHSAKKF

SEQ ID NO: 4228 - protein, 19 aa, Artificial
  Short Peptide
KKKLFLKIPPKFKHSAKKF

SEQ ID NO: 4229 - protein, 19 aa, Artificial
  Short Peptide
RKKLFLKIPPKFKHSAKKF

SEQ ID NO: 4230 - protein, 19 aa, Artificial
  Short Peptide
FKKLFLKIPPKFKHSAKKF

SEQ ID NO: 4231 - protein, 19 aa, Artificial
  Short Peptide
KWKLFLKIPPKFKHSAKKF

SEQ ID NO: 4232 - protein, 19 aa, Artificial
  Short Peptide
RWKLFLKIPPKFKHSAKKF

SEQ ID NO: 4233 - protein, 19 aa, Artificial
  Short Peptide
FWKLFLKIPPKFKHSAKKF

SEQ ID NO: 4234 - protein, 19 aa, Artificial
  Short Peptide
KKKKFLKIPPKFKHSAKKF

SEQ ID NO: 4235 - protein, 19 aa, Artificial
  Short Peptide
RKKKFLKIPPKFKHSAKKF

SEQ ID NO: 4236 - protein, 19 aa, Artificial
  Short Peptide
FKKKFLKIPPKFKHSAKKF

SEQ ID NO: 4237 - protein, 19 aa, Artificial
  Short Peptide
KWKKFLKIPPKFKHSAKKF

SEQ ID NO: 4238 - protein, 19 aa, Artificial
  Short Peptide
RWKKFLKIPPKFKHSAKKF

SEQ ID NO: 4239 - protein, 19 aa, Artificial
  Short Peptide
FWKKFLKIPPKFKHSAKKF

SEQ ID NO: 4240 - protein, 19 aa, Artificial
  Short Peptide
KKKLLLKIPPKFKHSAKKF

SEQ ID NO: 4241 - protein, 19 aa, Artificial
  Short Peptide
RKKLLLKIPPKFKHSAKKF

SEQ ID NO: 4242 - protein, 19 aa, Artificial
  Short Peptide
FKKLLLKIPPKFKHSAKKF

SEQ ID NO: 4243 - protein, 19 aa, Artificial
  Short Peptide
KWKLLLKIPPKFKHSAKKF

SEQ ID NO: 4244 - protein, 19 aa, Artificial
  Short Peptide
RWKLLLKIPPKFKHSAKKF

SEQ ID NO: 4245 - protein, 19 aa, Artificial
  Short Peptide
FWKLLLKIPPKFKHSAKKF

SEQ ID NO: 4246 - protein, 19 aa, Artificial
  Short Peptide
KKKKLLKIPPKFKHSAKKF

SEQ ID NO: 4247 - protein, 19 aa, Artificial
  Short Peptide
RKKKLLKIPPKFKHSAKKF

SEQ ID NO: 4248 - protein, 19 aa, Artificial
  Short Peptide
FKKKLLKIPPKFKHSAKKF

SEQ ID NO: 4249 - protein, 19 aa, Artificial
  Short Peptide
KWKKLLKIPPKFKHSAKKF

SEQ ID NO: 4250 - protein, 19 aa, Artificial
  Short Peptide
RWKKLLKIPPKFKHSAKKF

SEQ ID NO: 4251 - protein, 19 aa, Artificial
  Short Peptide
FWKKLLKIPPKFKHSAKKF

SEQ ID NO: 4252 - protein, 19 aa, Artificial
  Short Peptide
KKKLFKKIPPKFKHSAKKF

SEQ ID NO: 4253 - protein, 19 aa, Artificial
  Short Peptide
RKKLFKKIPPKFKHSAKKF

SEQ ID NO: 4254 - protein, 19 aa, Artificial
  Short Peptide
FKKLFKKIPPKFKHSAKKF

SEQ ID NO: 4255 - protein, 19 aa, Artificial
  Short Peptide
KWKLFKKIPPKFKHSAKKF

SEQ ID NO: 4256 - protein, 19 aa, Artificial
  Short Peptide
RWKLFKKIPPKFKHSAKKF

SEQ ID NO: 4257 - protein, 19 aa, Artificial
  Short Peptide
FWKLFKKIPPKFKHSAKKF

SEQ ID NO: 4258 - protein, 19 aa, Artificial
  Short Peptide
KKKKFKKIPPKFKHSAKKF

SEQ ID NO: 4259 - protein, 19 aa, Artificial
  Short Peptide
RKKKFKKIPPKFKHSAKKF

SEQ ID NO: 4260 - protein, 19 aa, Artificial
  Short Peptide
FKKKFKKIPPKFKHSAKKF

SEQ ID NO: 4261 - protein, 19 aa, Artificial
  Short Peptide
KWKKFKKIPPKFKHSAKKF

SEQ ID NO: 4262 - protein, 19 aa, Artificial
  Short Peptide
RWKKFKKIPPKFKHSAKKF

SEQ ID NO: 4263 - protein, 19 aa, Artificial
  Short Peptide
FWKKFKKIPPKFKHSAKKF

SEQ ID NO: 4264 - protein, 19 aa, Artificial
  Short Peptide
KKKLLKKIPPKFKHSAKKF

SEQ ID NO: 4265 - protein, 19 aa, Artificial
  Short Peptide
RKKLLKKIPPKFKHSAKKF

SEQ ID NO: 4266 - protein, 19 aa, Artificial
  Short Peptide
FKKLLKKIPPKFKHSAKKF

SEQ ID NO: 4267 - protein, 19 aa, Artificial
  Short Peptide
KWKLLKKIPPKFKHSAKKF

SEQ ID NO: 4268 - protein, 19 aa, Artificial
  Short Peptide
RWKLLKKIPPKFKHSAKKF

SEQ ID NO: 4269 - protein, 19 aa, Artificial
  Short Peptide
FWKLLKKIPPKFKHSAKKF

SEQ ID NO: 4270 - protein, 19 aa, Artificial
  Short Peptide
KKKKLKKIPPKFKHSAKKF

SEQ ID NO: 4271 - protein, 19 aa, Artificial
  Short Peptide
RKKKLKKIPPKFKHSAKKF

SEQ ID NO: 4272 - protein, 19 aa, Artificial
  Short Peptide
FKKKLKKIPPKFKHSAKKF

SEQ ID NO: 4273 - protein, 19 aa, Artificial
  Short Peptide
KWKKLKKIPPKFKHSAKKF

SEQ ID NO: 4274 - protein, 19 aa, Artificial
  Short Peptide
RWKKLKKIPPKFKHSAKKF

SEQ ID NO: 4275 - protein, 19 aa, Artificial
  Short Peptide
FWKKLKKIPPKFKHSAKKF

SEQ ID NO: 4276 - protein, 18 aa, Artificial
  Short Peptide
KKKLFLKIPKFKHSAKKF

SEQ ID NO: 4277 - protein, 18 aa, Artificial
  Short Peptide
RKKLFLKIPKFKHSAKKF

SEQ ID NO: 4278 - protein, 18 aa, Artificial
  Short Peptide
FKKLFLKIPKFKHSAKKF

SEQ ID NO: 4279 - protein, 18 aa, Artificial
  Short Peptide
KWKLFLKIPKFKHSAKKF

SEQ ID NO: 4280 - protein, 18 aa, Artificial
  Short Peptide
RWKLFLKIPKFKHSAKKF

SEQ ID NO: 4281 - protein, 18 aa, Artificial
  Short Peptide
FWKLFLKIPKFKHSAKKF

SEQ ID NO: 4282 - protein, 18 aa, Artificial
  Short Peptide
KKKKFLKIPKFKHSAKKF

SEQ ID NO: 4283 - protein, 18 aa, Artificial
  Short Peptide
RKKKFLKIPKFKHSAKKF

SEQ ID NO: 4284 - protein, 18 aa, Artificial
  Short Peptide
FKKKFLKIPKFKHSAKKF

SEQ ID NO: 4285 - protein, 18 aa, Artificial
  Short Peptide
KWKKFLKIPKFKHSAKKF

SEQ ID NO: 4286 - protein, 18 aa, Artificial
  Short Peptide
RWKKFLKIPKFKHSAKKF

SEQ ID NO: 4287 - protein, 18 aa, Artificial
  Short Peptide
FWKKFLKIPKFKHSAKKF

SEQ ID NO: 4288 - protein, 18 aa, Artificial
  Short Peptide
KKKLLLKIPKFKHSAKKF

SEQ ID NO: 4289 - protein, 18 aa, Artificial
  Short Peptide
RKKLLLKIPKFKHSAKKF

SEQ ID NO: 4290 - protein, 18 aa, Artificial
  Short Peptide
FKKLLLKIPKFKHSAKKF

SEQ ID NO: 4291 - protein, 18 aa, Artificial
  Short Peptide
KWKLLLKIPKFKHSAKKF

SEQ ID NO: 4292 - protein, 18 aa, Artificial
  Short Peptide
RWKLLLKIPKFKHSAKKF

SEQ ID NO: 4293 - protein, 18 aa, Artificial
  Short Peptide
FWKLLLKIPKFKHSAKKF

SEQ ID NO: 4294 - protein, 18 aa, Artificial
  Short Peptide
KKKKLLKIPKFKHSAKKF

SEQ ID NO: 4295 - protein, 18 aa, Artificial
  Short Peptide
RKKKLLKIPKFKHSAKKF

SEQ ID NO: 4296 - protein, 18 aa, Artificial
  Short Peptide
FKKKLLKIPKFKHSAKKF

SEQ ID NO: 4297 - protein, 18 aa, Artificial
  Short Peptide
KWKKLLKIPKFKHSAKKF

SEQ ID NO: 4298 - protein, 18 aa, Artificial
  Short Peptide
RWKKLLKIPKFKHSAKKF

SEQ ID NO: 4299 - protein, 18 aa, Artificial
  Short Peptide
FWKKLLKIPKFKHSAKKF

SEQ ID NO: 4300 - protein, 18 aa, Artificial
  Short Peptide
KKKLFKKIPKFKHSAKKF

SEQ ID NO: 4301 - protein, 18 aa, Artificial
  Short Peptide
RKKLFKKIPKFKHSAKKF

SEQ ID NO: 4302 - protein, 18 aa, Artificial
  Short Peptide
FKKLFKKIPKFKHSAKKF

SEQ ID NO: 4303 - protein, 18 aa, Artificial
  Short Peptide
KWKLFKKIPKFKHSAKKF

SEQ ID NO: 4304 - protein, 18 aa, Artificial
  Short Peptide
RWKLFKKIPKFKHSAKKF

SEQ ID NO: 4305 - protein, 18 aa, Artificial
  Short Peptide
FWKLFKKIPKFKHSAKKF

SEQ ID NO: 4306 - protein, 18 aa, Artificial
  Short Peptide
KKKKFKKIPKFKHSAKKF

SEQ ID NO: 4307 - protein, 18 aa, Artificial
  Short Peptide
RKKKFKKIPKFKHSAKKF

SEQ ID NO: 4308 - protein, 18 aa, Artificial
  Short Peptide
FKKKFKKIPKFKHSAKKF

SEQ ID NO: 4309 - protein, 18 aa, Artificial
  Short Peptide
KWKKFKKIPKFKHSAKKF

SEQ ID NO: 4310 - protein, 18 aa, Artificial
  Short Peptide
RWKKFKKIPKFKHSAKKF

SEQ ID NO: 4311 - protein, 18 aa, Artificial
  Short Peptide
FWKKFKKIPKFKHSAKKF

SEQ ID NO: 4312 - protein, 18 aa, Artificial
  Short Peptide
KKKLLKKIPKFKHSAKKF

SEQ ID NO: 4313 - protein, 18 aa, Artificial
  Short Peptide
RKKLLKKIPKFKHSAKKF

SEQ ID NO: 4314 - protein, 18 aa, Artificial
  Short Peptide
FKKLLKKIPKFKHSAKKF

SEQ ID NO: 4315 - protein, 18 aa, Artificial
  Short Peptide
KWKLLKKIPKFKHSAKKF

SEQ ID NO: 4316 - protein, 18 aa, Artificial
  Short Peptide
RWKLLKKIPKFKHSAKKF

SEQ ID NO: 4317 - protein, 18 aa, Artificial
  Short Peptide
FWKLLKKIPKFKHSAKKF

SEQ ID NO: 4318 - protein, 18 aa, Artificial
  Short Peptide
KKKKLKKIPKFKHSAKKF

SEQ ID NO: 4319 - protein, 18 aa, Artificial
  Short Peptide
RKKKLKKIPKFKHSAKKF

SEQ ID NO: 4320 - protein, 18 aa, Artificial
  Short Peptide
FKKKLKKIPKFKHSAKKF

SEQ ID NO: 4321 - protein, 18 aa, Artificial
  Short Peptide
KWKKLKKIPKFKHSAKKF

SEQ ID NO: 4322 - protein, 18 aa, Artificial
  Short Peptide
RWKKLKKIPKFKHSAKKF

SEQ ID NO: 4323 - protein, 18 aa, Artificial
  Short Peptide
FWKKLKKIPKFKHSAKKF

SEQ ID NO: 4324 - protein, 20 aa, Artificial
  Short Peptide
KKKLFLKIPPPKFLKSAKKF

SEQ ID NO: 4325 - protein, 20 aa, Artificial
  Short Peptide
RKKLFLKIPPPKFLKSAKKF

SEQ ID NO: 4326 - protein, 20 aa, Artificial
  Short Peptide
FKKLFLKIPPPKFLKSAKKF

SEQ ID NO: 4327 - protein, 20 aa, Artificial
  Short Peptide
KWKLFLKIPPPKFLKSAKKF

SEQ ID NO: 4328 - protein, 20 aa, Artificial
  Short Peptide
RWKLFLKIPPPKFLKSAKKF

SEQ ID NO: 4329 - protein, 20 aa, Artificial
  Short Peptide
FWKLFLKIPPPKFLKSAKKF

SEQ ID NO: 4330 - protein, 20 aa, Artificial
  Short Peptide
KKKKFLKIPPPKFLKSAKKF

SEQ ID NO: 4331 - protein, 20 aa, Artificial
  Short Peptide
RKKKFLKIPPPKFLKSAKKF

SEQ ID NO: 4332 - protein, 20 aa, Artificial
  Short Peptide
FKKKFLKIPPPKFLKSAKKF

SEQ ID NO: 4333 - protein, 20 aa, Artificial
  Short Peptide
KWKKFLKIPPPKFLKSAKKF

SEQ ID NO: 4334 - protein, 20 aa, Artificial
  Short Peptide
RWKKFLKIPPPKFLKSAKKF

SEQ ID NO: 4335 - protein, 20 aa, Artificial
  Short Peptide
FWKKFLKIPPPKFLKSAKKF

SEQ ID NO: 4336 - protein, 20 aa, Artificial
  Short Peptide
KKKLLLKIPPPKFLKSAKKF

SEQ ID NO: 4337 - protein, 20 aa, Artificial
  Short Peptide
RKKLLLKIPPPKFLKSAKKF

SEQ ID NO: 4338 - protein, 20 aa, Artificial
  Short Peptide
FKKLLLKIPPPKFLKSAKKF

SEQ ID NO: 4339 - protein, 20 aa, Artificial
  Short Peptide
KWKLLLKIPPPKFLKSAKKF

SEQ ID NO: 4340 - protein, 20 aa, Artificial
  Short Peptide
RWKLLLKIPPPKFLKSAKKF

SEQ ID NO: 4341 - protein, 20 aa, Artificial
  Short Peptide
FWKLLLKIPPPKFLKSAKKF

SEQ ID NO: 4342 - protein, 20 aa, Artificial
  Short Peptide
KKKKLLKIPPPKFLKSAKKF

SEQ ID NO: 4343 - protein, 20 aa, Artificial
  Short Peptide
RKKKLLKIPPPKFLKSAKKF

SEQ ID NO: 4344 - protein, 20 aa, Artificial
  Short Peptide
FKKKLLKIPPPKFLKSAKKF

SEQ ID NO: 4345 - protein, 20 aa, Artificial
  Short Peptide
KWKKLLKIPPPKFLKSAKKF

SEQ ID NO: 4346 - protein, 20 aa, Artificial
  Short Peptide
RWKKLLKIPPPKFLKSAKKF

SEQ ID NO: 4347 - protein, 20 aa, Artificial
  Short Peptide
FWKKLLKIPPPKFLKSAKKF

SEQ ID NO: 4348 - protein, 20 aa, Artificial
  Short Peptide
KKKLFKKIPPPKFLKSAKKF

SEQ ID NO: 4349 - protein, 20 aa, Artificial
  Short Peptide
RKKLFKKIPPPKFLKSAKKF

SEQ ID NO: 4350 - protein, 20 aa, Artificial
  Short Peptide
FKKLFKKIPPPKFLKSAKKF

SEQ ID NO: 4351 - protein, 20 aa, Artificial
  Short Peptide
KWKLFKKIPPPKFLKSAKKF

SEQ ID NO: 4352 - protein, 20 aa, Artificial
  Short Peptide
RWKLFKKIPPPKFLKSAKKF

SEQ ID NO: 4353 - protein, 20 aa, Artificial
  Short Peptide
FWKLFKKIPPPKFLKSAKKF

SEQ ID NO: 4354 - protein, 20 aa, Artificial
  Short Peptide
KKKKFKKIPPPKFLKSAKKF

SEQ ID NO: 4355 - protein, 20 aa, Artificial
  Short Peptide
RKKKFKKIPPPKFLKSAKKF

SEQ ID NO: 4356 - protein, 20 aa, Artificial
  Short Peptide
FKKKFKKIPPPKFLKSAKKF

SEQ ID NO: 4357 - protein, 20 aa, Artificial
  Short Peptide
KWKKFKKIPPPKFLKSAKKF

SEQ ID NO: 4358 - protein, 20 aa, Artificial
  Short Peptide
RWKKFKKIPPPKFLKSAKKF

SEQ ID NO: 4359 - protein, 20 aa, Artificial
  Short Peptide
FWKKFKKIPPPKFLKSAKKF

SEQ ID NO: 4360 - protein, 20 aa, Artificial
  Short Peptide
KKKLLKKIPPPKFLKSAKKF

SEQ ID NO: 4361 - protein, 20 aa, Artificial
  Short Peptide
RKKLLKKIPPPKFLKSAKKF

SEQ ID NO: 4362 - protein, 20 aa, Artificial
  Short Peptide
FKKLLKKIPPPKFLKSAKKF

SEQ ID NO: 4363 - protein, 20 aa, Artificial
  Short Peptide
KWKLLKKIPPPKFLKSAKKF

SEQ ID NO: 4364 - protein, 20 aa, Artificial
  Short Peptide
RWKLLKKIPPPKFLKSAKKF

SEQ ID NO: 4365 - protein, 20 aa, Artificial
  Short Peptide
FWKLLKKIPPPKFLKSAKKF

SEQ ID NO: 4366 - protein, 20 aa, Artificial
  Short Peptide
KKKKLKKIPPPKFLKSAKKF

SEQ ID NO: 4367 - protein, 20 aa, Artificial
  Short Peptide
RKKKLKKIPPPKFLKSAKKF

SEQ ID NO: 4368 - protein, 20 aa, Artificial
  Short Peptide
FKKKLKKIPPPKFLKSAKKF

SEQ ID NO: 4369 - protein, 20 aa, Artificial
  Short Peptide
KWKKLKKIPPPKFLKSAKKF

SEQ ID NO: 4370 - protein, 20 aa, Artificial
  Short Peptide
RWKKLKKIPPPKFLKSAKKF

SEQ ID NO: 4371 - protein, 20 aa, Artificial
  Short Peptide
FWKKLKKIPPPKFLKSAKKF

SEQ ID NO: 4372 - protein, 19 aa, Artificial
  Short Peptide
KKKLFLKIPPKFLKSAKKF

SEQ ID NO: 4373 - protein, 19 aa, Artificial
  Short Peptide
RKKLFLKIPPKFLKSAKKF

SEQ ID NO: 4374 - protein, 19 aa, Artificial
  Short Peptide
FKKLFLKIPPKFLKSAKKF

SEQ ID NO: 4375 - protein, 19 aa, Artificial
  Short Peptide
KWKLFLKIPPKFLKSAKKF

SEQ ID NO: 4376 - protein, 19 aa, Artificial
  Short Peptide
RWKLFLKIPPKFLKSAKKF

SEQ ID NO: 4377 - protein, 19 aa, Artificial
  Short Peptide
FWKLFLKIPPKFLKSAKKF

SEQ ID NO: 4378 - protein, 19 aa, Artificial
  Short Peptide
KKKKFLKIPPKFLKSAKKF

SEQ ID NO: 4379 - protein, 19 aa, Artificial
  Short Peptide
RKKKFLKIPPKFLKSAKKF

SEQ ID NO: 4380 - protein, 19 aa, Artificial
  Short Peptide
FKKKFLKIPPKFLKSAKKF

SEQ ID NO: 4381 - protein, 19 aa, Artificial
  Short Peptide
KWKKFLKIPPKFLKSAKKF

SEQ ID NO: 4382 - protein, 19 aa, Artificial
  Short Peptide
RWKKFLKIPPKFLKSAKKF

SEQ ID NO: 4383 - protein, 19 aa, Artificial
  Short Peptide
FWKKFLKIPPKFLKSAKKF

SEQ ID NO: 4384 - protein, 19 aa, Artificial
  Short Peptide
KKKLLLKIPPKFLKSAKKF

SEQ ID NO: 4385 - protein, 19 aa, Artificial
  Short Peptide
RKKLLLKIPPKFLKSAKKF

SEQ ID NO: 4386 - protein, 19 aa, Artificial
  Short Peptide
FKKLLLKIPPKFLKSAKKF

SEQ ID NO: 4387 - protein, 19 aa, Artificial
  Short Peptide
KWKLLLKIPPKFLKSAKKF

SEQ ID NO: 4388 - protein, 19 aa, Artificial
  Short Peptide
RWKLLLKIPPKFLKSAKKF

SEQ ID NO: 4389 - protein, 19 aa, Artificial
  Short Peptide
FWKLLLKIPPKFLKSAKKF

SEQ ID NO: 4390 - protein, 19 aa, Artificial
  Short Peptide
KKKKLLKIPPKFLKSAKKF

SEQ ID NO: 4391 - protein, 19 aa, Artificial
  Short Peptide
RKKKLLKIPPKFLKSAKKF

SEQ ID NO: 4392 - protein, 19 aa, Artificial
  Short Peptide
FKKKLLKIPPKFLKSAKKF

SEQ ID NO: 4393 - protein, 19 aa, Artificial
  Short Peptide
KWKKLLKIPPKFLKSAKKF

SEQ ID NO: 4394 - protein, 19 aa, Artificial
  Short Peptide
RWKKLLKIPPKFLKSAKKF

SEQ ID NO: 4395 - protein, 19 aa, Artificial
  Short Peptide
FWKKLLKIPPKFLKSAKKF

SEQ ID NO: 4396 - protein, 19 aa, Artificial
  Short Peptide
KKKLFKKIPPKFLKSAKKF

SEQ ID NO: 4397 - protein, 19 aa, Artificial
  Short Peptide
RKKLFKKIPPKFLKSAKKF

SEQ ID NO: 4398 - protein, 19 aa, Artificial
  Short Peptide
FKKLFKKIPPKFLKSAKKF

SEQ ID NO: 4399 - protein, 19 aa, Artificial
  Short Peptide
KWKLFKKIPPKFLKSAKKF

SEQ ID NO: 4400 - protein, 19 aa, Artificial
  Short Peptide
RWKLFKKIPPKFLKSAKKF

SEQ ID NO: 4401 - protein, 19 aa, Artificial
  Short Peptide
FWKLFKKIPPKFLKSAKKF

SEQ ID NO: 4402 - protein, 19 aa, Artificial
  Short Peptide
KKKKFKKIPPKFLKSAKKF

SEQ ID NO: 4403 - protein, 19 aa, Artificial
  Short Peptide
RKKKFKKIPPKFLKSAKKF

SEQ ID NO: 4404 - protein, 19 aa, Artificial
  Short Peptide
FKKKFKKIPPKFLKSAKKF

SEQ ID NO: 4405 - protein, 19 aa, Artificial
  Short Peptide
KWKKFKKIPPKFLKSAKKF

SEQ ID NO: 4406 - protein, 19 aa, Artificial
  Short Peptide
RWKKFKKIPPKFLKSAKKF

SEQ ID NO: 4407 - protein, 19 aa, Artificial
  Short Peptide
FWKKFKKIPPKFLKSAKKF

SEQ ID NO: 4408 - protein, 19 aa, Artificial
  Short Peptide
KKKLLKKIPPKFLKSAKKF

SEQ ID NO: 4409 - protein, 19 aa, Artificial
  Short Peptide
RKKLLKKIPPKFLKSAKKF

SEQ ID NO: 4410 - protein, 19 aa, Artificial
  Short Peptide
FKKLLKKIPPKFLKSAKKF

SEQ ID NO: 4411 - protein, 19 aa, Artificial
  Short Peptide
KWKLLKKIPPKFLKSAKKF

SEQ ID NO: 4412 - protein, 19 aa, Artificial
  Short Peptide
RWKLLKKIPPKFLKSAKKF

SEQ ID NO: 4413 - protein, 19 aa, Artificial
  Short Peptide
FWKLLKKIPPKFLKSAKKF

SEQ ID NO: 4414 - protein, 19 aa, Artificial
  Short Peptide
KKKKLKKIPPKFLKSAKKF

SEQ ID NO: 4415 - protein, 19 aa, Artificial
  Short Peptide
RKKKLKKIPPKFLKSAKKF

SEQ ID NO: 4416 - protein, 19 aa, Artificial
  Short Peptide
FKKKLKKIPPKFLKSAKKF

SEQ ID NO: 4417 - protein, 19 aa, Artificial
  Short Peptide
KWKKLKKIPPKFLKSAKKF

SEQ ID NO: 4418 - protein, 19 aa, Artificial
  Short Peptide
RWKKLKKIPPKFLKSAKKF

SEQ ID NO: 4419 - protein, 19 aa, Artificial
  Short Peptide
FWKKLKKIPPKFLKSAKKF

SEQ ID NO: 4420 - protein, 18 aa, Artificial
  Short Peptide
KKKLFLKIPKFLKSAKKF

SEQ ID NO: 4421 - protein, 18 aa, Artificial
  Short Peptide
RKKLFLKIPKFLKSAKKF

SEQ ID NO: 4422 - protein, 18 aa, Artificial
  Short Peptide
FKKLFLKIPKFLKSAKKF

SEQ ID NO: 4423 - protein, 18 aa, Artificial
  Short Peptide
KWKLFLKIPKFLKSAKKF

SEQ ID NO: 4424 - protein, 18 aa, Artificial
  Short Peptide
RWKLFLKIPKFLKSAKKF

SEQ ID NO: 4425 - protein, 18 aa, Artificial
  Short Peptide
FWKLFLKIPKFLKSAKKF

SEQ ID NO: 4426 - protein, 18 aa, Artificial
  Short Peptide
KKKKFLKIPKFLKSAKKF

SEQ ID NO: 4427 - protein, 18 aa, Artificial
  Short Peptide
RKKKFLKIPKFLKSAKKF

SEQ ID NO: 4428 - protein, 18 aa, Artificial
  Short Peptide
FKKKFLKIPKFLKSAKKF

SEQ ID NO: 4429 - protein, 18 aa, Artificial
  Short Peptide
KWKKFLKIPKFLKSAKKF

SEQ ID NO: 4430 - protein, 18 aa, Artificial
  Short Peptide
RWKKFLKIPKFLKSAKKF

SEQ ID NO: 4431 - protein, 18 aa, Artificial
  Short Peptide
FWKKFLKIPKFLKSAKKF

SEQ ID NO: 4432 - protein, 18 aa, Artificial
  Short Peptide
KKKLLLKIPKFLKSAKKF

SEQ ID NO: 4433 - protein, 18 aa, Artificial
  Short Peptide
RKKLLLKIPKFLKSAKKF

SEQ ID NO: 4434 - protein, 18 aa, Artificial
  Short Peptide
FKKLLLKIPKFLKSAKKF

SEQ ID NO: 4435 - protein, 18 aa, Artificial
  Short Peptide
KWKLLLKIPKFLKSAKKF

SEQ ID NO: 4436 - protein, 18 aa, Artificial
  Short Peptide
RWKLLLKIPKFLKSAKKF

SEQ ID NO: 4437 - protein, 18 aa, Artificial
  Short Peptide
FWKLLLKIPKFLKSAKKF

SEQ ID NO: 4438 - protein, 18 aa, Artificial
  Short Peptide
KKKKLLKIPKFLKSAKKF

SEQ ID NO: 4439 - protein, 18 aa, Artificial
  Short Peptide
RKKKLLKIPKFLKSAKKF

SEQ ID NO: 4440 - protein, 18 aa, Artificial
  Short Peptide
FKKKLLKIPKFLKSAKKF

SEQ ID NO: 4441 - protein, 18 aa, Artificial
  Short Peptide
KWKKLLKIPKFLKSAKKF

SEQ ID NO: 4442 - protein, 18 aa, Artificial
  Short Peptide
RWKKLLKIPKFLKSAKKF

SEQ ID NO: 4443 - protein, 18 aa, Artificial
  Short Peptide
FWKKLLKIPKFLKSAKKF

SEQ ID NO: 4444 - protein, 18 aa, Artificial
  Short Peptide
KKKLFKKIPKFLKSAKKF

SEQ ID NO: 4445 - protein, 18 aa, Artificial
  Short Peptide
RKKLFKKIPKFLKSAKKF

SEQ ID NO: 4446 - protein, 18 aa, Artificial
  Short Peptide
FKKLFKKIPKFLKSAKKF

SEQ ID NO: 4447 - protein, 18 aa, Artificial
  Short Peptide
KWKLFKKIPKFLKSAKKF

SEQ ID NO: 4448 - protein, 18 aa, Artificial
  Short Peptide
RWKLFKKIPKFLKSAKKF

SEQ ID NO: 4449 - protein, 18 aa, Artificial
  Short Peptide
FWKLFKKIPKFLKSAKKF

SEQ ID NO: 4450 - protein, 18 aa, Artificial
  Short Peptide
KKKKFKKIPKFLKSAKKF

SEQ ID NO: 4451 - protein, 18 aa, Artificial
  Short Peptide
RKKKFKKIPKFLKSAKKF

SEQ ID NO: 4452 - protein, 18 aa, Artificial
  Short Peptide
FKKKFKKIPKFLKSAKKF

SEQ ID NO: 4453 - protein, 18 aa, Artificial
  Short Peptide
KWKKFKKIPKFLKSAKKF

SEQ ID NO: 4454 - protein, 18 aa, Artificial
  Short Peptide
RWKKFKKIPKFLKSAKKF

SEQ ID NO: 4455 - protein, 18 aa, Artificial
  Short Peptide
FWKKFKKIPKFLKSAKKF

SEQ ID NO: 4456 - protein, 18 aa, Artificial
  Short Peptide
KKKLLKKIPKFLKSAKKF

SEQ ID NO: 4457 - protein, 18 aa, Artificial
  Short Peptide
RKKLLKKIPKFLKSAKKF

SEQ ID NO: 4458 - protein, 18 aa, Artificial
  Short Peptide
FKKLLKKIPKFLKSAKKF

SEQ ID NO: 4459 - protein, 18 aa, Artificial
  Short Peptide
KWKLLKKIPKFLKSAKKF

SEQ ID NO: 4460 - protein, 18 aa, Artificial
  Short Peptide
RWKLLKKIPKFLKSAKKF

SEQ ID NO: 4461 - protein, 18 aa, Artificial
  Short Peptide
FWKLLKKIPKFLKSAKKF

SEQ ID NO: 4462 - protein, 18 aa, Artificial
  Short Peptide
KKKKLKKIPKFLKSAKKF

SEQ ID NO: 4463 - protein, 18 aa, Artificial
  Short Peptide
RKKKLKKIPKFLKSAKKF

SEQ ID NO: 4464 - protein, 18 aa, Artificial
  Short Peptide
FKKKLKKIPKFLKSAKKF

SEQ ID NO: 4465 - protein, 18 aa, Artificial
  Short Peptide
KWKKLKKIPKFLKSAKKF

SEQ ID NO: 4466 - protein, 18 aa, Artificial
  Short Peptide
RWKKLKKIPKFLKSAKKF

SEQ ID NO: 4467 - protein, 18 aa, Artificial
  Short Peptide
FWKKLKKIPKFLKSAKKF

SEQ ID NO: 4468 - protein, 20 aa, Artificial
  Short Peptide
KKKLFLKIPPPKFKKSAKKF

SEQ ID NO: 4469 - protein, 20 aa, Artificial
  Short Peptide
RKKLFLKIPPPKFKKSAKKF

SEQ ID NO: 4470 - protein, 20 aa, Artificial
  Short Peptide
FKKLFLKIPPPKFKKSAKKF

SEQ ID NO: 4471 - protein, 20 aa, Artificial
  Short Peptide
KWKLFLKIPPPKFKKSAKKF

SEQ ID NO: 4472 - protein, 20 aa, Artificial
  Short Peptide
RWKLFLKIPPPKFKKSAKKF

SEQ ID NO: 4473 - protein, 20 aa, Artificial
  Short Peptide
FWKLFLKIPPPKFKKSAKKF

SEQ ID NO: 4474 - protein, 20 aa, Artificial
  Short Peptide
KKKKFLKIPPPKFKKSAKKF

SEQ ID NO: 4475 - protein, 20 aa, Artificial
  Short Peptide
RKKKFLKIPPPKFKKSAKKF

SEQ ID NO: 4476 - protein, 20 aa, Artificial
  Short Peptide
FKKKFLKIPPPKFKKSAKKF

SEQ ID NO: 4477 - protein, 20 aa, Artificial
  Short Peptide
KWKKFLKIPPPKFKKSAKKF

SEQ ID NO: 4478 - protein, 20 aa, Artificial
  Short Peptide
RWKKFLKIPPPKFKKSAKKF

SEQ ID NO: 4479 - protein, 20 aa, Artificial
  Short Peptide
FWKKFLKIPPPKFKKSAKKF

SEQ ID NO: 4480 - protein, 20 aa, Artificial
  Short Peptide
KKKLLLKIPPPKFKKSAKKF

SEQ ID NO: 4481 - protein, 20 aa, Artificial
  Short Peptide
RKKLLLKIPPPKFKKSAKKF

SEQ ID NO: 4482 - protein, 20 aa, Artificial
  Short Peptide
FKKLLLKIPPPKFKKSAKKF

SEQ ID NO: 4483 - protein, 20 aa, Artificial
  Short Peptide
KWKLLLKIPPPKFKKSAKKF

SEQ ID NO: 4484 - protein, 20 aa, Artificial
  Short Peptide
RWKLLLKIPPPKFKKSAKKF

SEQ ID NO: 4485 - protein, 20 aa, Artificial
  Short Peptide
FWKLLLKIPPPKFKKSAKKF

SEQ ID NO: 4486 - protein, 20 aa, Artificial
  Short Peptide
KKKKLLKIPPPKFKKSAKKF

SEQ ID NO: 4487 - protein, 20 aa, Artificial
  Short Peptide
RKKKLLKIPPPKFKKSAKKF

SEQ ID NO: 4488 - protein, 20 aa, Artificial
  Short Peptide
FKKKLLKIPPPKFKKSAKKF

SEQ ID NO: 4489 - protein, 20 aa, Artificial
  Short Peptide
KWKKLLKIPPPKFKKSAKKF

SEQ ID NO: 4490 - protein, 20 aa, Artificial
  Short Peptide
RWKKLLKIPPPKFKKSAKKF

SEQ ID NO: 4491 - protein, 20 aa, Artificial
  Short Peptide
FWKKLLKIPPPKFKKSAKKF

SEQ ID NO: 4492 - protein, 20 aa, Artificial
  Short Peptide
KKKLFKKIPPPKFKKSAKKF

SEQ ID NO: 4493 - protein, 20 aa, Artificial
  Short Peptide
RKKLFKKIPPPKFKKSAKKF

SEQ ID NO: 4494 - protein, 20 aa, Artificial
  Short Peptide
FKKLFKKIPPPKFKKSAKKF

SEQ ID NO: 4495 - protein, 20 aa, Artificial
  Short Peptide
KWKLFKKIPPPKFKKSAKKF

SEQ ID NO: 4496 - protein, 20 aa, Artificial
  Short Peptide
RWKLFKKIPPPKFKKSAKKF

SEQ ID NO: 4497 - protein, 20 aa, Artificial
  Short Peptide
FWKLFKKIPPPKFKKSAKKF

SEQ ID NO: 4498 - protein, 20 aa, Artificial
  Short Peptide
KKKKFKKIPPPKFKKSAKKF

SEQ ID NO: 4499 - protein, 20 aa, Artificial
  Short Peptide
RKKKFKKIPPPKFKKSAKKF

SEQ ID NO: 4500 - protein, 20 aa, Artificial
  Short Peptide
FKKKFKKIPPPKFKKSAKKF

SEQ ID NO: 4501 - protein, 20 aa, Artificial
  Short Peptide
KWKKFKKIPPPKFKKSAKKF

SEQ ID NO: 4502 - protein, 20 aa, Artificial
  Short Peptide
RWKKFKKIPPPKFKKSAKKF

SEQ ID NO: 4503 - protein, 20 aa, Artificial
  Short Peptide
FWKKFKKIPPPKFKKSAKKF

SEQ ID NO: 4504 - protein, 20 aa, Artificial
  Short Peptide
KKKLLKKIPPPKFKKSAKKF

SEQ ID NO: 4505 - protein, 20 aa, Artificial
  Short Peptide
RKKLLKKIPPPKFKKSAKKF

SEQ ID NO: 4506 - protein, 20 aa, Artificial
  Short Peptide
FKKLLKKIPPPKFKKSAKKF

SEQ ID NO: 4507 - protein, 20 aa, Artificial
  Short Peptide
KWKLLKKIPPPKFKKSAKKF

SEQ ID NO: 4508 - protein, 20 aa, Artificial
  Short Peptide
RWKLLKKIPPPKFKKSAKKF

SEQ ID NO: 4509 - protein, 20 aa, Artificial
  Short Peptide
FWKLLKKIPPPKFKKSAKKF

SEQ ID NO: 4510 - protein, 20 aa, Artificial
  Short Peptide
KKKKLKKIPPPKFKKSAKKF

SEQ ID NO: 4511 - protein, 20 aa, Artificial
  Short Peptide
RKKKLKKIPPPKFKKSAKKF

SEQ ID NO: 4512 - protein, 20 aa, Artificial
  Short Peptide
FKKKLKKIPPPKFKKSAKKF

SEQ ID NO: 4513 - protein, 20 aa, Artificial
  Short Peptide
KWKKLKKIPPPKFKKSAKKF

SEQ ID NO: 4514 - protein, 20 aa, Artificial
  Short Peptide
RWKKLKKIPPPKFKKSAKKF

SEQ ID NO: 4515 - protein, 20 aa, Artificial
  Short Peptide
FWKKLKKIPPPKFKKSAKKF

SEQ ID NO: 4516 - protein, 19 aa, Artificial
  Short Peptide
KKKLFLKIPPKFKKSAKKF

SEQ ID NO: 4517 - protein, 19 aa, Artificial
  Short Peptide
RKKLFLKIPPKFKKSAKKF

SEQ ID NO: 4518 - protein, 19 aa, Artificial
  Short Peptide
FKKLFLKIPPKFKKSAKKF

SEQ ID NO: 4519 - protein, 19 aa, Artificial
  Short Peptide
KWKLFLKIPPKFKKSAKKF

SEQ ID NO: 4520 - protein, 19 aa, Artificial
  Short Peptide
RWKLFLKIPPKFKKSAKKF

SEQ ID NO: 4521 - protein, 19 aa, Artificial
  Short Peptide
FWKLFLKIPPKFKKSAKKF

SEQ ID NO: 4522 - protein, 19 aa, Artificial
  Short Peptide
KKKKFLKIPPKFKKSAKKF

SEQ ID NO: 4523 - protein, 19 aa, Artificial
  Short Peptide
RKKKFLKIPPKFKKSAKKF

SEQ ID NO: 4524 - protein, 19 aa, Artificial
  Short Peptide
FKKKFLKIPPKFKKSAKKF

SEQ ID NO: 4525 - protein, 19 aa, Artificial
  Short Peptide
KWKKFLKIPPKFKKSAKKF

SEQ ID NO: 4526 - protein, 19 aa, Artificial
  Short Peptide
RWKKFLKIPPKFKKSAKKF

SEQ ID NO: 4527 - protein, 19 aa, Artificial
  Short Peptide
FWKKFLKIPPKFKKSAKKF

SEQ ID NO: 4528 - protein, 19 aa, Artificial
  Short Peptide
KKKLLLKIPPKFKKSAKKF

SEQ ID NO: 4529 - protein, 19 aa, Artificial
  Short Peptide
RKKLLLKIPPKFKKSAKKF

SEQ ID NO: 4530 - protein, 19 aa, Artificial
  Short Peptide
FKKLLLKIPPKFKKSAKKF

SEQ ID NO: 4531 - protein, 19 aa, Artificial
  Short Peptide
KWKLLLKIPPKFKKSAKKF

SEQ ID NO: 4532 - protein, 19 aa, Artificial
  Short Peptide
RWKLLLKIPPKFKKSAKKF

SEQ ID NO: 4533 - protein, 19 aa, Artificial
  Short Peptide
FWKLLLKIPPKFKKSAKKF

SEQ ID NO: 4534 - protein, 19 aa, Artificial
  Short Peptide
KKKKLLKIPPKFKKSAKKF

SEQ ID NO: 4535 - protein, 19 aa, Artificial
  Short Peptide
RKKKLLKIPPKFKKSAKKF

SEQ ID NO: 4536 - protein, 19 aa, Artificial
  Short Peptide
FKKKLLKIPPKFKKSAKKF

SEQ ID NO: 4537 - protein, 19 aa, Artificial
  Short Peptide
KWKKLLKIPPKFKKSAKKF

SEQ ID NO: 4538 - protein, 19 aa, Artificial
  Short Peptide
RWKKLLKIPPKFKKSAKKF

SEQ ID NO: 4539 - protein, 19 aa, Artificial
  Short Peptide
FWKKLLKIPPKFKKSAKKF

SEQ ID NO: 4540 - protein, 19 aa, Artificial
  Short Peptide
KKKLFKKIPPKFKKSAKKF

SEQ ID NO: 4541 - protein, 19 aa, Artificial
  Short Peptide
RKKLFKKIPPKFKKSAKKF

SEQ ID NO: 4542 - protein, 19 aa, Artificial
  Short Peptide
FKKLFKKIPPKFKKSAKKF

SEQ ID NO: 4543 - protein, 19 aa, Artificial
  Short Peptide
KWKLFKKIPPKFKKSAKKF

SEQ ID NO: 4544 - protein, 19 aa, Artificial
  Short Peptide
RWKLFKKIPPKFKKSAKKF

SEQ ID NO: 4545 - protein, 19 aa, Artificial
  Short Peptide
FWKLFKKIPPKFKKSAKKF

SEQ ID NO: 4546 - protein, 19 aa, Artificial
  Short Peptide
KKKKFKKIPPKFKKSAKKF

SEQ ID NO: 4547 - protein, 19 aa, Artificial
  Short Peptide
RKKKFKKIPPKFKKSAKKF

SEQ ID NO: 4548 - protein, 19 aa, Artificial
  Short Peptide
FKKKFKKIPPKFKKSAKKF

SEQ ID NO: 4549 - protein, 19 aa, Artificial
  Short Peptide
KWKKFKKIPPKFKKSAKKF

SEQ ID NO: 4550 - protein, 19 aa, Artificial
  Short Peptide
RWKKFKKIPPKFKKSAKKF

SEQ ID NO: 4551 - protein, 19 aa, Artificial
  Short Peptide
FWKKFKKIPPKFKKSAKKF

SEQ ID NO: 4552 - protein, 19 aa, Artificial
  Short Peptide
KKKLLKKIPPKFKKSAKKF

SEQ ID NO: 4553 - protein, 19 aa, Artificial
  Short Peptide
RKKLLKKIPPKFKKSAKKF

SEQ ID NO: 4554 - protein, 19 aa, Artificial
  Short Peptide
FKKLLKKIPPKFKKSAKKF

SEQ ID NO: 4555 - protein, 19 aa, Artificial
  Short Peptide
KWKLLKKIPPKFKKSAKKF

SEQ ID NO: 4556 - protein, 19 aa, Artificial
  Short Peptide
RWKLLKKIPPKFKKSAKKF

SEQ ID NO: 4557 - protein, 19 aa, Artificial
  Short Peptide
FWKLLKKIPPKFKKSAKKF

SEQ ID NO: 4558 - protein, 19 aa, Artificial
  Short Peptide
KKKKLKKIPPKFKKSAKKF

SEQ ID NO: 4559 - protein, 19 aa, Artificial
  Short Peptide
RKKKLKKIPPKFKKSAKKF

SEQ ID NO: 4560 - protein, 19 aa, Artificial
  Short Peptide
FKKKLKKIPPKFKKSAKKF

SEQ ID NO: 4561 - protein, 19 aa, Artificial
  Short Peptide
KWKKLKKIPPKFKKSAKKF

SEQ ID NO: 4562 - protein, 19 aa, Artificial
  Short Peptide
RWKKLKKIPPKFKKSAKKF

SEQ ID NO: 4563 - protein, 19 aa, Artificial
  Short Peptide
FWKKLKKIPPKFKKSAKKF

SEQ ID NO: 4564 - protein, 18 aa, Artificial
  Short Peptide
KKKLFLKIPKFKKSAKKF

SEQ ID NO: 4565 - protein, 18 aa, Artificial
  Short Peptide
RKKLFLKIPKFKKSAKKF

SEQ ID NO: 4566 - protein, 18 aa, Artificial
  Short Peptide
FKKLFLKIPKFKKSAKKF

SEQ ID NO: 4567 - protein, 18 aa, Artificial
  Short Peptide
KWKLFLKIPKFKKSAKKF

SEQ ID NO: 4568 - protein, 18 aa, Artificial
  Short Peptide
RWKLFLKIPKFKKSAKKF

SEQ ID NO: 4569 - protein, 18 aa, Artificial
  Short Peptide
FWKLFLKIPKFKKSAKKF

SEQ ID NO: 4570 - protein, 18 aa, Artificial
  Short Peptide
KKKKFLKIPKFKKSAKKF

SEQ ID NO: 4571 - protein, 18 aa, Artificial
  Short Peptide
RKKKFLKIPKFKKSAKKF

SEQ ID NO: 4572 - protein, 18 aa, Artificial
  Short Peptide
FKKKFLKIPKFKKSAKKF

SEQ ID NO: 4573 - protein, 18 aa, Artificial
  Short Peptide
KWKKFLKIPKFKKSAKKF

SEQ ID NO: 4574 - protein, 18 aa, Artificial
  Short Peptide
RWKKFLKIPKFKKSAKKF

SEQ ID NO: 4575 - protein, 18 aa, Artificial
  Short Peptide
FWKKFLKIPKFKKSAKKF

SEQ ID NO: 4576 - protein, 18 aa, Artificial
  Short Peptide
KKKLLLKIPKFKKSAKKF

SEQ ID NO: 4577 - protein, 18 aa, Artificial
  Short Peptide
RKKLLLKIPKFKKSAKKF

SEQ ID NO: 4578 - protein, 18 aa, Artificial
  Short Peptide
FKKLLLKIPKFKKSAKKF

SEQ ID NO: 4579 - protein, 18 aa, Artificial
  Short Peptide
KWKLLLKIPKFKKSAKKF

SEQ ID NO: 4580 - protein, 18 aa, Artificial
  Short Peptide
RWKLLLKIPKFKKSAKKF

SEQ ID NO: 4581 - protein, 18 aa, Artificial
  Short Peptide
FWKLLLKIPKFKKSAKKF

SEQ ID NO: 4582 - protein, 18 aa, Artificial
  Short Peptide
KKKKLLKIPKFKKSAKKF

SEQ ID NO: 4583 - protein, 18 aa, Artificial
  Short Peptide
RKKKLLKIPKFKKSAKKF

SEQ ID NO: 4584 - protein, 18 aa, Artificial
  Short Peptide
FKKKLLKIPKFKKSAKKF

SEQ ID NO: 4585 - protein, 18 aa, Artificial
  Short Peptide
KWKKLLKIPKFKKSAKKF

SEQ ID NO: 4586 - protein, 18 aa, Artificial
  Short Peptide
RWKKLLKIPKFKKSAKKF

SEQ ID NO: 4587 - protein, 18 aa, Artificial
  Short Peptide
FWKKLLKIPKFKKSAKKF

SEQ ID NO: 4588 - protein, 18 aa, Artificial
  Short Peptide
KKKLFKKIPKFKKSAKKF

SEQ ID NO: 4589 - protein, 18 aa, Artificial
  Short Peptide
RKKLFKKIPKFKKSAKKF

SEQ ID NO: 4590 - protein, 18 aa, Artificial
  Short Peptide
FKKLFKKIPKFKKSAKKF

SEQ ID NO: 4591 - protein, 18 aa, Artificial
  Short Peptide
KWKLFKKIPKFKKSAKKF

SEQ ID NO: 4592 - protein, 18 aa, Artificial
  Short Peptide
RWKLFKKIPKFKKSAKKF

SEQ ID NO: 4593 - protein, 18 aa, Artificial
  Short Peptide
FWKLFKKIPKFKKSAKKF

SEQ ID NO: 4594 - protein, 18 aa, Artificial
  Short Peptide
KKKKFKKIPKFKKSAKKF

SEQ ID NO: 4595 - protein, 18 aa, Artificial
  Short Peptide
RKKKFKKIPKFKKSAKKF

SEQ ID NO: 4596 - protein, 18 aa, Artificial
  Short Peptide
FKKKFKKIPKFKKSAKKF

SEQ ID NO: 4597 - protein, 18 aa, Artificial
  Short Peptide
KWKKFKKIPKFKKSAKKF

SEQ ID NO: 4598 - protein, 18 aa, Artificial
  Short Peptide
RWKKFKKIPKFKKSAKKF

SEQ ID NO: 4599 - protein, 18 aa, Artificial
  Short Peptide
FWKKFKKIPKFKKSAKKF

SEQ ID NO: 4600 - protein, 18 aa, Artificial
  Short Peptide
KKKLLKKIPKFKKSAKKF

SEQ ID NO: 4601 - protein, 18 aa, Artificial
  Short Peptide
RKKLLKKIPKFKKSAKKF

SEQ ID NO: 4602 - protein, 18 aa, Artificial
  Short Peptide
FKKLLKKIPKFKKSAKKF

SEQ ID NO: 4603 - protein, 18 aa, Artificial
  Short Peptide
KWKLLKKIPKFKKSAKKF

SEQ ID NO: 4604 - protein, 18 aa, Artificial
  Short Peptide
RWKLLKKIPKFKKSAKKF

SEQ ID NO: 4605 - protein, 18 aa, Artificial
  Short Peptide
FWKLLKKIPKFKKSAKKF

SEQ ID NO: 4606 - protein, 18 aa, Artificial
  Short Peptide
KKKKLKKIPKFKKSAKKF

SEQ ID NO: 4607 - protein, 18 aa, Artificial
  Short Peptide
RKKKLKKIPKFKKSAKKF

SEQ ID NO: 4608 - protein, 18 aa, Artificial
  Short Peptide
FKKKLKKIPKFKKSAKKF

SEQ ID NO: 4609 - protein, 18 aa, Artificial
  Short Peptide
KWKKLKKIPKFKKSAKKF

SEQ ID NO: 4610 - protein, 18 aa, Artificial
  Short Peptide
RWKKLKKIPKFKKSAKKF

SEQ ID NO: 4611 - protein, 18 aa, Artificial
  Short Peptide
FWKKLKKIPKFKKSAKKF

SEQ ID NO: 4612 - protein, 20 aa, Artificial
  Short Peptide
KLKLLLKIPPPKFLHAAKKF

SEQ ID NO: 4613 - protein, 20 aa, Artificial
  Short Peptide
KLKKLLKIPPPKFLHAAKKF

SEQ ID NO: 4614 - protein, 20 aa, Artificial
  Short Peptide
KLKLFLKIPPPKFLHAAKKF

SEQ ID NO: 4615 - protein, 20 aa, Artificial
  Short Peptide
KLKKFLKIPPPKFLHAAKKF

SEQ ID NO: 4616 - protein, 20 aa, Artificial
  Short Peptide
KLKLLKKIPPPKFLHAAKKF

SEQ ID NO: 4617 - protein, 20 aa, Artificial
  Short Peptide
KLKKLKKIPPPKFLHAAKKF

SEQ ID NO: 4618 - protein, 20 aa, Artificial
  Short Peptide
KLKLFKKIPPPKFLHAAKKF

SEQ ID NO: 4619 - protein, 20 aa, Artificial
  Short Peptide
KLKKFKKIPPPKFLHAAKKF

SEQ ID NO: 4620 - protein, 19 aa, Artificial
  Short Peptide
KLKLLLKIPPKFLHAAKKF

SEQ ID NO: 4621 - protein, 19 aa, Artificial
  Short Peptide
KLKKLLKIPPKFLHAAKKF

SEQ ID NO: 4622 - protein, 19 aa, Artificial
  Short Peptide
KLKLFLKIPPKFLHAAKKF

SEQ ID NO: 4623 - protein, 19 aa, Artificial
  Short Peptide
KLKKFLKIPPKFLHAAKKF

SEQ ID NO: 4624 - protein, 19 aa, Artificial
  Short Peptide
KLKLLKKIPPKFLHAAKKF

SEQ ID NO: 4625 - protein, 19 aa, Artificial
  Short Peptide
KLKKLKKIPPKFLHAAKKF

SEQ ID NO: 4626 - protein, 19 aa, Artificial
  Short Peptide
KLKLFKKIPPKFLHAAKKF

SEQ ID NO: 4627 - protein, 19 aa, Artificial
  Short Peptide
KLKKFKKIPPKFLHAAKKF

SEQ ID NO: 4628 - protein, 18 aa, Artificial
  Short Peptide
KLKLLLKIPKFLHAAKKF

SEQ ID NO: 4629 - protein, 18 aa, Artificial
  Short Peptide
KLKKLLKIPKFLHAAKKF

SEQ ID NO: 4630 - protein, 18 aa, Artificial
  Short Peptide
KLKLFLKIPKFLHAAKKF

SEQ ID NO: 4631 - protein, 18 aa, Artificial
  Short Peptide
KLKKFLKIPKFLHAAKKF

SEQ ID NO: 4632 - protein, 18 aa, Artificial
  Short Peptide
KLKLLKKIPKFLHAAKKF

SEQ ID NO: 4633 - protein, 18 aa, Artificial
  Short Peptide
KLKKLKKIPKFLHAAKKF

SEQ ID NO: 4634 - protein, 18 aa, Artificial
  Short Peptide
KLKLFKKIPKFLHAAKKF

SEQ ID NO: 4635 - protein, 18 aa, Artificial
  Short Peptide
KLKKFKKIPKFLHAAKKF

SEQ ID NO: 4636 - protein, 20 aa, Artificial
  Short Peptide
KLKLLLKIPPPKFLHVAKKF

SEQ ID NO: 4637 - protein, 20 aa, Artificial
  Short Peptide
KLKKLLKIPPPKFLHVAKKF

SEQ ID NO: 4638 - protein, 20 aa, Artificial
  Short Peptide
KLKLFLKIPPPKFLHVAKKF

SEQ ID NO: 4639 - protein, 20 aa, Artificial
  Short Peptide
KLKKFLKIPPPKFLHVAKKF

SEQ ID NO: 4640 - protein, 20 aa, Artificial
  Short Peptide
KLKLLKKIPPPKFLHVAKKF

SEQ ID NO: 4641 - protein, 20 aa, Artificial
  Short Peptide
KLKKLKKIPPPKFLHVAKKF

SEQ ID NO: 4642 - protein, 20 aa, Artificial
  Short Peptide
KLKLFKKIPPPKFLHVAKKF

SEQ ID NO: 4643 - protein, 20 aa, Artificial
  Short Peptide
KLKKFKKIPPPKFLHVAKKF

SEQ ID NO: 4644 - protein, 19 aa, Artificial
  Short Peptide
KLKLLLKIPPKFLHVAKKF

SEQ ID NO: 4645 - protein, 19 aa, Artificial
  Short Peptide
KLKKLLKIPPKFLHVAKKF

SEQ ID NO: 4646 - protein, 19 aa, Artificial
  Short Peptide
KLKLFLKIPPKFLHVAKKF

SEQ ID NO: 4647 - protein, 19 aa, Artificial
  Short Peptide
KLKKFLKIPPKFLHVAKKF

SEQ ID NO: 4648 - protein, 19 aa, Artificial
  Short Peptide
KLKLLKKIPPKFLHVAKKF

SEQ ID NO: 4649 - protein, 19 aa, Artificial
  Short Peptide
KLKKLKKIPPKFLHVAKKF

SEQ ID NO: 4650 - protein, 19 aa, Artificial
  Short Peptide
KLKLFKKIPPKFLHVAKKF

SEQ ID NO: 4651 - protein, 19 aa, Artificial
  Short Peptide
KLKKFKKIPPKFLHVAKKF

SEQ ID NO: 4652 - protein, 18 aa, Artificial
  Short Peptide
KLKLLLKIPKFLHVAKKF

SEQ ID NO: 4653 - protein, 18 aa, Artificial
  Short Peptide
KLKKLLKIPKFLHVAKKF

SEQ ID NO: 4654 - protein, 18 aa, Artificial
  Short Peptide
KLKLFLKIPKFLHVAKKF

SEQ ID NO: 4655 - protein, 18 aa, Artificial
  Short Peptide
KLKKFLKIPKFLHVAKKF

SEQ ID NO: 4656 - protein, 18 aa, Artificial
  Short Peptide
KLKLLKKIPKFLHVAKKF

SEQ ID NO: 4657 - protein, 18 aa, Artificial
  Short Peptide
KLKKLKKIPKFLHVAKKF

SEQ ID NO: 4658 - protein, 18 aa, Artificial
  Short Peptide
KLKLFKKIPKFLHVAKKF

SEQ ID NO: 4659 - protein, 18 aa, Artificial
  Short Peptide
KLKKFKKIPKFLHVAKKF

SEQ ID NO: 4660 - protein, 20 aa, Artificial
  Short Peptide
KLKLLLKIPPPKFLHLAKKF

SEQ ID NO: 4661 - protein, 20 aa, Artificial
  Short Peptide
KLKKLLKIPPPKFLHLAKKF

SEQ ID NO: 4662 - protein, 20 aa, Artificial
  Short Peptide
KLKLFLKIPPPKFLHLAKKF

SEQ ID NO: 4663 - protein, 20 aa, Artificial
  Short Peptide
KLKKFLKIPPPKFLHLAKKF

SEQ ID NO: 4664 - protein, 20 aa, Artificial
  Short Peptide
KLKLLKKIPPPKFLHLAKKF

SEQ ID NO: 4665 - protein, 20 aa, Artificial
  Short Peptide
KLKKLKKIPPPKFLHLAKKF

SEQ ID NO: 4666 - protein, 20 aa, Artificial
  Short Peptide
KLKLFKKIPPPKFLHLAKKF

SEQ ID NO: 4667 - protein, 20 aa, Artificial
  Short Peptide
KLKKFKKIPPPKFLHLAKKF

SEQ ID NO: 4668 - protein, 19 aa, Artificial
  Short Peptide
KLKLLLKIPPKFLHLAKKF

SEQ ID NO: 4669 - protein, 19 aa, Artificial
  Short Peptide
KLKKLLKIPPKFLHLAKKF

SEQ ID NO: 4670 - protein, 19 aa, Artificial
  Short Peptide
KLKLFLKIPPKFLHLAKKF

SEQ ID NO: 4671 - protein, 19 aa, Artificial
  Short Peptide
KLKKFLKIPPKFLHLAKKF

SEQ ID NO: 4672 - protein, 19 aa, Artificial
  Short Peptide
KLKLLKKIPPKFLHLAKKF

SEQ ID NO: 4673 - protein, 19 aa, Artificial
  Short Peptide
KLKKLKKIPPKFLHLAKKF

SEQ ID NO: 4674 - protein, 19 aa, Artificial
  Short Peptide
KLKLFKKIPPKFLHLAKKF

SEQ ID NO: 4675 - protein, 19 aa, Artificial
  Short Peptide
KLKKFKKIPPKFLHLAKKF

SEQ ID NO: 4676 - protein, 18 aa, Artificial
  Short Peptide
KLKLLLKIPKFLHLAKKF

SEQ ID NO: 4677 - protein, 18 aa, Artificial
  Short Peptide
KLKKLLKIPKFLHLAKKF

SEQ ID NO: 4678 - protein, 18 aa, Artificial
  Short Peptide
KLKLFLKIPKFLHLAKKF

SEQ ID NO: 4679 - protein, 18 aa, Artificial
  Short Peptide
KLKKFLKIPKFLHLAKKF

SEQ ID NO: 4680 - protein, 18 aa, Artificial
  Short Peptide
KLKLLKKIPKFLHLAKKF

SEQ ID NO: 4681 - protein, 18 aa, Artificial
  Short Peptide
KLKKLKKIPKFLHLAKKF

SEQ ID NO: 4682 - protein, 18 aa, Artificial
  Short Peptide
KLKLFKKIPKFLHLAKKF

SEQ ID NO: 4683 - protein, 18 aa, Artificial
  Short Peptide
KLKKFKKIPKFLHLAKKF

SEQ ID NO: 4684 - protein, 20 aa, Artificial
  Short Peptide
KLKLLLKIPPPKFLHSAKKF

SEQ ID NO: 4685 - protein, 20 aa, Artificial
  Short Peptide
KLKKLLKIPPPKFLHSAKKF

SEQ ID NO: 4686 - protein, 20 aa, Artificial
  Short Peptide
KLKLFLKIPPPKFLHSAKKF

SEQ ID NO: 4687 - protein, 20 aa, Artificial
  Short Peptide
KLKKFLKIPPPKFLHSAKKF

SEQ ID NO: 4688 - protein, 20 aa, Artificial
  Short Peptide
KLKLLKKIPPPKFLHSAKKF

SEQ ID NO: 4689 - protein, 20 aa, Artificial
  Short Peptide
KLKKLKKIPPPKFLHSAKKF

SEQ ID NO: 4690 - protein, 20 aa, Artificial
  Short Peptide
KLKLFKKIPPPKFLHSAKKF

SEQ ID NO: 4691 - protein, 20 aa, Artificial
  Short Peptide
KLKKFKKIPPPKFLHSAKKF

SEQ ID NO: 4692 - protein, 19 aa, Artificial
  Short Peptide
KLKLLLKIPPKFLHSAKKF

SEQ ID NO: 4693 - protein, 19 aa, Artificial
  Short Peptide
KLKKLLKIPPKFLHSAKKF

SEQ ID NO: 4694 - protein, 19 aa, Artificial
  Short Peptide
KLKLFLKIPPKFLHSAKKF

SEQ ID NO: 4695 - protein, 19 aa, Artificial
  Short Peptide
KLKKFLKIPPKFLHSAKKF

SEQ ID NO: 4696 - protein, 19 aa, Artificial
  Short Peptide
KLKLLKKIPPKFLHSAKKF

SEQ ID NO: 4697 - protein, 19 aa, Artificial
  Short Peptide
KLKKLKKIPPKFLHSAKKF

SEQ ID NO: 4698 - protein, 19 aa, Artificial
  Short Peptide
KLKLFKKIPPKFLHSAKKF

SEQ ID NO: 4699 - protein, 19 aa, Artificial
  Short Peptide
KLKKFKKIPPKFLHSAKKF

SEQ ID NO: 4700 - protein, 18 aa, Artificial
  Short Peptide
KLKLLLKIPKFLHSAKKF

SEQ ID NO: 4701 - protein, 18 aa, Artificial
  Short Peptide
KLKKLLKIPKFLHSAKKF

SEQ ID NO: 4702 - protein, 18 aa, Artificial
  Short Peptide
KLKLFLKIPKFLHSAKKF

SEQ ID NO: 4703 - protein, 18 aa, Artificial
  Short Peptide
KLKKFLKIPKFLHSAKKF

SEQ ID NO: 4704 - protein, 18 aa, Artificial
  Short Peptide
KLKLLKKIPKFLHSAKKF

SEQ ID NO: 4705 - protein, 18 aa, Artificial
  Short Peptide
KLKKLKKIPKFLHSAKKF

SEQ ID NO: 4706 - protein, 18 aa, Artificial
  Short Peptide
KLKLFKKIPKFLHSAKKF

SEQ ID NO: 4707 - protein, 18 aa, Artificial
  Short Peptide
KLKKFKKIPKFLHSAKKF

SEQ ID NO: 4708 - protein, 18 aa, Artificial
  Short Peptide
KWKLFKKIPKFLHSAKKF

SEQ ID NO: 4709 - protein, 19 aa, Artificial
  Short Peptide
  MOD_RES (19)..(19): AMIDATION
KWKLFKKIGPKFLHLAKKF

SEQ ID NO: 4710 - protein, 19 aa, Artificial
  Short Peptide
  MOD_RES (19)..(19): AMIDATION
KWKLFKKGPGKFLHSAKKF

SEQ ID NO: 4711 - protein, 26 aa, Artificial
  Short Peptide
  MOD_RES (26)..(26): AMIDATION
KWKLFKKIEKVGQGPGKFLHSAKKFG

SEQ ID NO: 4712 - protein, 17 aa, Artificial
  Short Peptide
  MOD_RES (17)..(17): AMIDATION
WKLFKKIPKFLHLAKKF

SEQ ID NO: 4713 - protein, 17 aa, Artificial
  Short Peptide
  MOD_RES (17)..(17): AMIDATION
FKLFLLIPKFLHLAKKF

SEQ ID NO: 4714 - protein, 16 aa, Artificial
  Short Peptide
  MOD_RES (16)..(16): AMIDATION
KWFKKIPKFLHLAKKF

SEQ ID NO: 4715 - protein, 15 aa, Artificial
  Short Peptide
  MOD_RES (15)..(15): AMIDATION
WFKKIPKFLHLAKKF

SEQ ID NO: 4716 - protein, 15 aa, Artificial
  Short Peptide
  MOD_RES (15)..(15): AMIDATION
KWKKIPKFLHLLKKF

SEQ ID NO: 4717 - protein, 15 aa, Artificial
  Short Peptide
  MOD_RES (15)..(15): AMIDATION
WFKKIPKFLHLLKKF

SEQ ID NO: 4718 - protein, 17 aa, Artificial
  Short Peptide
  MOD_RES (17)..(17): AMIDATION
KWKLFKKIPFLHLAKKF

SEQ ID NO: 4719 - protein, 17 aa, Artificial
  Short Peptide
  MOD_RES (17)..(17): AMIDATION
KWKLFKKIPKFLHLAKK

SEQ ID NO: 4720 - protein, 16 aa, Artificial
  Short Peptide
  MOD_RES (16)..(16): AMIDATION
KWKLFKKIPLHLAKKF

SEQ ID NO: 4721 - protein, 16 aa, Artificial
  Short Peptide
  MOD_RES (16)..(16): AMIDATION
KWKLFKKIPKFLHLAK

SEQ ID NO: 4722 - protein, 15 aa, Artificial
  Short Peptide
  MOD_RES (15)..(15): AMIDATION
KWKLFKKIPHLAKKF

SEQ ID NO: 4723 - protein, 15 aa, Artificial
  Short Peptide
  MOD_RES (15)..(15): AMIDATION
KWKLFKKIPKFLHLA

SEQ ID NO: 4724 - protein, 14 aa, Artificial
  Short Peptide
  MOD_RES (14)..(14): AMIDATION
KWKLFKKIPLAKKF

SEQ ID NO: 4725 - protein, 14 aa, Artificial
  Short Peptide
  MOD_RES (14)..(14): AMIDATION
KWKLFKKIPKFLHL

SEQ ID NO: 4726 - protein, 18 aa, Artificial
  Short Peptide
  MOD_RES (18)..(18): AMIDATION
FKKALHLFKPIKKFLKWK

SEQ ID NO: 4727 - protein, 18 aa, Artificial
  Short Peptide
  MOD_RES (18)..(18): AMIDATION
KFLHLAKKFPKWKLFKKI

SEQ ID NO: 4728 - protein, 18 aa, Artificial
  Short Peptide
  MOD_RES (18)..(18): AMIDATION
KWKKLLKKPLLKKLLKKL

SEQ ID NO: 4729 - protein, 15 aa, Artificial
  Short Peptide
  MOD_RES (15)..(15): AMIDATION
KWKLKPLLKKLLKKL

SEQ ID NO: 4730 - protein, 14 aa, Artificial
  Short Peptide
  MOD_RES (14)..(14): AMIDATION
KWKKLLKKPLKLKL

SEQ ID NO: 4731 - protein, 11 aa, Artificial
  Short Peptide
  MOD_RES (11)..(11): AMIDATION
KLLKKPLKLKL

SEQ ID NO: 4732 - protein, 19 aa, Artificial
  Short Peptide
  MOD_RES (19)..(19): AMIDATION
PKWKLFKKIPKFLHLAKKF

SEQ ID NO: 4733 - protein, 19 aa, Artificial
  Short Peptide
  MOD_RES (19)..(19): AMIDATION
KWKLFKKIPKFLHLAKKFD

SEQ ID NO: 4734 - protein, 20 aa, Artificial
  Short Peptide
  MOD_RES (20)..(20): AMIDATION
PKWKLFKKIPKFLHLAKKFD

SEQ ID NO: 4735 - protein, 19 aa, Artificial
  Short Peptide
  MOD_RES (19)..(19): AMIDATION
GKWKLFKKIPKFLHLAKKF

SEQ ID NO: 4736 - protein, 19 aa, Artificial
  Short Peptide
  MOD_RES (19)..(19): AMIDATION
KWKLFKKIPKFLHLAKKFN

SEQ ID NO: 4737 - protein, 20 aa, Artificial
  Short Peptide
  MOD_RES (20)..(20): AMIDATION
GKWKLFKKIPKFLHLAKKFN

SEQ ID NO: 4738 - protein, 20 aa, Artificial
  Short Peptide
  MOD_RES (20)..(20): AMIDATION
PKWKLFKKIPKFLHLAKKFN

SEQ ID NO: 4739 - protein, 20 aa, Artificial Sequence
  synthetic peptide
KWKKLLKKPPPLLKKLLKKL

SEQ ID NO: 4740 - protein, 8 aa, Artificial Sequence
  hydrophilically-hydrophobically separated helix sequence motif
KLKKLLKK

SEQ ID NO: 4741 - protein, 6 aa, Artificial Sequence
  linker group
GGSGGT

SEQ ID NO: 4742 - protein, 6 aa, Artificial Sequence
  linker group
GGSGGS

The invention claimed is:

1. A method for treatment of dandruff, comprising topical application to a person in need of treatment of dandruff of a composition comprising a cosmetic carrier and a *Malassezia furfur*-inhibiting amount of at least one peptide with a sequence or a repetitive sequence motif according to SEQ ID NO: 2:

(SEQ ID NO: 2)
$X_1$ $X_2$K $X_3$ $X_4$ $X_5$KIP $X_{11}$ $X_{12}$ KF$X_6$$X_7$ $X_8$ A$X_9$KF in which
$X_1$ is lysine, arginine or phenylalanine,
$X_2$ is lysine or tryptophan,
$X_3$ is leucine or lysine,
$X_4$ is phenylalanine or leucine, $X_5$ is leucine or lysine,
$X_6$ is leucine or lysine,
$X_7$ is histidine or lysine,
$X_8$ is alanine, leucine, valine or serine,
$X_9$ is leucine or lysine,
$X_{11}$ is proline or a chemical bond, and
$X_{12}$ is proline or a chemical bond,
where the repetitive sequence motifs are identical or different; or peptide derivatives thereof selected from the group consisting of aliphatic esters, amides, N-acyl peptides, O-acyl peptides, and peptides wherein between 1 to 5 arbitrary amino acid residues are N- and/or C-terminally added or deleted.

2. The method of claim 1, wherein the composition comprises a peptide with a sequence or a repetitive sequence motif according to SEQ ID NO: 3

```
KWKLFKKIPKFLHLAKKF      (SEQ ID NO: 3)
``` or peptide derivatives thereof selected from the group consisting of aliphatic esters, amides, N-acyl peptides, O-acyl peptides, and peptides wherein between 1 to 5 arbitrary amino acid residues are N- and/or C-terminally added or deleted.

3. The method of claim 2, wherein the composition comprises a peptide with a repetitive sequence motif, where a plurality of peptides according to SEQ ID NO: 3 or said peptide derivatives thereof are peptidically linked together via linker groups.

4. The method of claim 1, wherein the composition comprises a peptide with a repetitive sequence motif, where a plurality of peptides according to SEQ ID NO: 2 or said peptide derivatives thereof are peptidically linked together via linker groups.

5. The method according to of claim 4, where the linkers comprise 1 to 10 continuous identical or different amino acid residues selected from alanine, glycine, threonine and serine.

6. The method of claim 1, where the C-terminal carboxyl group of the peptide is amidated.

7. The method of claim 1, wherein the composition inhibits *Malassezia furfur* under standard conditions at a minimum inhibitory concentration of about 0.1 µM-1500 µM.

8. The method of claim 1, wherein the composition additionally comprises at least one further cosmetic or pharmaceutical active ingredient.

9. The method of claim 1, wherein the composition additionally comprises at least one anti-inflammatory active ingredient.

10. The method of claim 1, wherein the composition additionally comprises an antimicrobial active ingredient for inhibiting the growth and/or the activity of undesired germs.

11. The method of claim 1, wherein the composition additionally comprises a sebum-regulating active ingredient.

12. The method of claim 1, where the peptide is present in the composition in a fraction of from 0.0001 to 50% by weight, based on the total weight of the finished composition.

* * * * *